US007812128B2

(12) United States Patent
Aburatani et al.

(10) Patent No.: US 7,812,128 B2
(45) Date of Patent: Oct. 12, 2010

(54) GENE OVEREXPRESSED IN CANCER

(76) Inventors: Hiroyuki Aburatani, 3-30-16, Kichijoji Minami-cho, Musashino-shi, Tokyo (JP) 180-0003; Yoshitaka Hippo, 3A Lee St., Huntington, NY (US) 11743; Hirokazu Taniguchi, 1-35-12-408, Nozawa, Setagaya-ku, Tokyo (JP) 154-0003; Yong xin Chen, 7458 Louis Pasteur, #1103, San Antonio, TX (US) 78229; Shumpei Ishikawa, 2-17-3-301, Yayoi, Bunkyo-ku, Tokyo (JP) 113-0032; Shin-ichi Fukumoto, 5-2-1-1-701 Kikusui, Shiroishi-ku, Sapporo (JP) 003-0805; Takahiro Shimamura, 358-1-207, Nakajima, Fuji City, Shizuoka (JP) 416-0907; Naoko Kamimura, 3-4-8-303, Nishi-Ikebukuro, Toshima-ku, Tokyo (JP) 171-0021; Ying qiu Guo, 7458 Louis Pasteur, #1103, San Antonio, TX (US) 78229; Shogo Yamamoto, 4-4-17, Nishi-Ohi, Shinagawa-ku, Tokyo (JP) 140-0015; Yukio Ito, c/o Perseus Proteomics Inc., 1-10, Koraku 1-chome, Bunkyo-ku, Tokyo (JP) 112-0004; Hirotaka Ito, c/o Chugai Seiyaku Kabushiki Kaisha, 135, Komakado 1-chome, Gotenba-shi, Shizuoka (JP) 412-8513; Toshihiko Ohtomo, c/o Chugai Seiyaku Kabushiki Kaisha, 153-2, Nagai, Nishihari-mura, Nishihari-gun, Ibaraki (JP) 300-4101

( * ) Notice: Subject to any disclaimer, the term of this patent is extended or adjusted under 35 U.S.C. 154(b) by 37 days.

(21) Appl. No.: 12/229,750

(22) Filed: Aug. 26, 2008

(65) Prior Publication Data
US 2009/0192108 A1 Jul. 30, 2009

Related U.S. Application Data

(63) Continuation of application No. 11/584,793, filed on Oct. 20, 2006, now abandoned, which is a continuation of application No. 10/568,471, filed as application No. PCT/JP2004/011650 on Aug. 6, 2004.

(30) Foreign Application Priority Data

Aug. 8, 2003 (JP) ............... 2003-290704

(51) Int. Cl.
C07K 14/00 (2006.01)
(52) U.S. Cl. ................... 530/350; 530/387.1
(58) Field of Classification Search ............. None
See application file for complete search history.

(56) References Cited

U.S. PATENT DOCUMENTS 6,251,613 B1   6/2001  Kishimoto et al.

6,743,619 B1 * 6/2004 Tang et al. ................ 435/233
2003/0003538 A1   1/2003 Dietrich et al.
2007/0020637 A1 * 1/2007 Isogai et al. ................ 435/6

FOREIGN PATENT DOCUMENTS

| EP | 0857780 | 8/1998 |
|---|---|---|
| EP | 1016717 | 7/2000 |
| EP | 1 293 569 A2 | 3/2003 |
| JP | H09-203734 | 8/1997 |
| WO | WO-97/10333 | 3/1997 |
| WO | WO-99/00495 | 1/1999 |
| WO | WO 02/26982 A2 | 4/2002 |
| WO | WO 02/46415 A2 | 6/2002 |
| WO | WO 03/029424 A2 | 4/2003 |
| WO | WO 2004/040000 A2 | 5/2004 |
| WO | WO 2004/087874 A2 | 10/2004 |

OTHER PUBLICATIONS

Verma et al. (1997) Nature, vol. 389, pp. 239-242.*
Marshall (1995) Science, vol. 269, pp. 1050-1055.*
Eck et al. (Goodman & Gilman's The Pharmacological Basis of Therapeutics (1996), 9th Edition, Chapter 5, McGraw-W, NY.*
Ross et al. Human Gene Therapy, 1996, vol. 7, pp. 1781-1790, No abstract available.*
Scheurle, et al., Cancer gene discovery using digital differential display, Cancer Research, Aug. 1, 2000, vol. 60 (15), pp. 4037-4043.
Matthias, P.A. Ebert, et al., Expression of Metallothionein II in Intestinal Metaplasia, Dysplasia, and Gastric Cancer, Cancer Research, Apr. 1, 2000, vol. 60, pp. 1995-2001.
Xu, et al., Insight into hepatocellular carcinogenesis at transcriptome level by comparing gene expression profiles of hepatocellular carcinoma with those of corresponding noncancerous liver, Proc. Natl. Acad. Sci. USA, Dec. 18, 2001, vol. 98 (26), pp. 15089-15094.
Inder Verma et al. "Gene Therapy—promises, problems and prospects" Nature, vol. 389, pp. 239-242, Sep. 18, 1997.
Eliot Marshall "Gene Therapy's Growing Pains" Science, vol. 269, pp. 1050-1055, Aug. 25, 1995.
Eck et al. (Goodman and Gilman's the Pharmacological Basis of Therapeutics (1996), 9th Edition, Chapter 5, McGraw-W, NY.
Ross et al. Human Gene Therapy, 1996, vol. 7 pp. 1781-1790.

(Continued)

Primary Examiner—Larry R. Helms
Assistant Examiner—Meera Natarajan

(57) ABSTRACT

Disclosed are a protein encoded by a gene having a nucleotide sequence represented by any of SEQ ID NOs: 1 to 65 or a fragment thereof, an antibody recognizing the protein or antigen-binding fragment thereof, and a polynucleotide having a sequence comprising at least 12 consecutive nucleotides of a nucleotide sequence represented by any of SEQ ID NOs: 1 to 65 or a nucleotide sequence complementary thereto. The gene and the protein of the invention is useful for diagnosing and treating cancer.

2 Claims, 66 Drawing Sheets

OTHER PUBLICATIONS

Office Action dated Feb. 26, 2008 issued in co-pending U.S. Appl. No. 11/584,793.

Liu, Z et al, "Rh type B glycoprotein is a new member of the Rh superfamily and a putative ammonia transporter in mammals", J. Biol. Chem. (2001), vol. 276, No. 2, pp. 1424-1433.

Liu, Z. et al, "Homo sapiens Rh type B glycoprotein (RHBG) mRNA, complete cds.". Genbank [online]; Jan. 2001, National Center for Biotechnology information, Bethesda, MD, USA, [Retrived on Apr. 6, 2010' Retrived from the Internet: URL:http://www.ncbi.nlm.nih.gov/sviewer/viewer.fcgi?val=9858561:34:557016$view=gb, Accession No. AF193807.1, GenInfo Identifer No. 9858561.

Kozak, Marilyn, "An analysis of 5'-noncoding sequences from 699 vertebrate messenger RNAs", Nucleic Acids Research. (1987), vol. 15, No. 20, p. 8125-8148.

Office Action dated May 7, 2010 issued in corresponding JP Patent Application No. 2005-513023.

* cited by examiner

```
ATGGCTTCGTTCCCCGAGACCGATTTCCAGATCTGCTTGCTGTGCAAGGAGATGTGCGGC        60
MetAlaSerPheProGluThrAspPheGlnIleCysLeuLeuCysLysGluMetCysGly        20

TCGCCGGCGCCGCTCTCCTCCAACTCGTCCGCGTCGTCGTCCTCCTCGCAGACGTCCACG       120
SerProAlaProLeuSerSerAsnSerSerAlaSerSerSerSerSerGlnThrSerThr        40

TCGTCGGGGGGCGGCGGCGGGGGCCCTGGGGCGGCGGCGCGCCGCCTACACGTCCTGCCC       180
SerSerGlyGlyGlyGlyGlyGlyProGlyAlaAlaAlaArgArgLeuHisValLeuPro        60

TGCCTGCACGCCTTCTGCCGCCCTGCCTCGAGGCGCACCGGCTGCCGGCGGCGGGCGGC       240
CysLeuHisAlaPheCysArgProCysLeuGluAlaHisArgLeuProAlaAlaGlyGly        80

GGCGCGGCGGGAGAGCCGCTCAAGCTGCGCTGCCCCGTGTGCGACCAGAAAGTAGTGCTA       300
GlyAlaAlaGlyGluProLeuLysLeuArgCysProValCysAspGlnLysValValLeu       100

GCCGAGGCGGCGGGTATGGACGCGCTGCCTTCGTCCGCCTTCCTGCTTAACAACCTGCTC       360
AlaGluAlaAlaGlyMETAspAlaLeuProSerSerAlaPheLeuLeuAsnAsnLeuLeu       120

GACGCGGTGGTGGCCACTGCCGACGAGCCGCCGCCCAAGAACGGGCGCGCCGGCGCTCCG       420
AspAlaValValAlaThrAlaAspGluProProProLysAsnGlyArgAlaGlyAlaPro       140

GCGGGAGCGGGCGGCCACAGCAACCACCGGCACCACGCTCACCACGCGCACCCGCGCGCG       480
AlaGlyAlaGlyGlyHisSerAsnHisArgHisHisAlaHisHisAlaHisProArgAla       160

TCCGCCTCCGCGCCGCCACTCCCGCAGGCGCCGCAGCCGCCCGCGCCTTCCCGCTCGGCA       540
SerAlaSerAlaProProLeuProGlnAlaProGlnProProAlaProSerArgSerAla       180

CCCGGCGGCCCTGCCGCTTCCCCGTCGGCGCTGCTGCTCCGCCGTCCTCACGGCTGCAGC       600
ProGlyGlyProAlaAlaSerProSerAlaLeuLeuLeuArgArgProHisGlyCysSer       200

TCGTGCGATGAGGGCAACGCAGCTTCTTCGCGCTGCCTCGACTGCCAGGAGCACCTGTGC       660
SerCysAspGluGlyAsnAlaAlaSerSerArgCysLeuAspCysGlnGluHisLeuCys       220

GACAACTGCGTCCGAGCGCACCAGCGCGTGCGCCTCACCAAGGACCACTACATCGAGCGC       720
AspAsnCysValArgAlaHisGlnArgValArgLeuThrLysAspHisTyrIleGluArg       240

GGCCCGCCGGGTCCCGGTGCCGCAGCAGCGGCGCAGCAGCTCGGGCTCGGGCCGCCCTTT       780
GlyProProGlyProGlyAlaAlaAlaAlaAlaGlnGlnLeuGlyLeuGlyProProPhe       260

CCCGGCCCGCCCTTCTCCATCCTCTCAGTGTTTCCCGAGCGCCTCGGCTTCTGCCAGCAC       840
ProGlyProProPheSerIleLeuSerValPheProGluArgLeuGlyPheCysGlnHis       280
```

FIG. 67

```
CACGACGACGAGGTGCTGCACCTGTACTGTGACACTTGCTCTGTACCCATCTGTCGTGAG    900
HisAspAspGluValLeuHisLeuTyrCysAspThrCysSerValProIleCysArgGlu    300

TGCACAATGGGCCGGCATGGGGCCACAGCTTCATCTACCTCCAGGAGGCACTGCAGGAC    960
CysThrMetGlyArgHisGlyGlyHisSerPheIleTyrLeuGlnGluAlaLeuGlnAsp    320

TCACGGGCACTCACCATCCAGCTGCTGGCAGATGCCCAGCAGGGACGACAGGCAATCCAG   1020
SerArgAlaLeuThrIleGlnLeuLeuAlaAspAlaGlnGlnGlyArgGlnAlaIleGln    340

CTGAGCATCGAGCAGGCCCAGACGGTGGCGGAACAGGTGGAGATGAAGGCGAAGGTTGTG   1080
LeuSerIleGluGlnAlaGlnThrValAlaGluGlnValGluMetLysAlaLysValVal    360

CAGTCGGAGGTCAAAGCCGTGACTGCGAGGCATAAGAAAGCCCTGGAGGAACGCGAGTGT   1140
GlnSerGluValLysAlaValThrAlaArgHisLysLysAlaLeuGluGluArgGluCys    380

GAGCTGCTGTGGAAGGTAGAAAAGATCCGCCAGGTGAAAGCCAAGTCTCTGTACCTGCAG   1200
GluLeuLeuTrpLysValGluLysIleArgGlnValLysAlaLysSerLeuTyrLeuGln    400

GTGGAGAAGCTGCGGCAAAACCTCAACAAGCTTGAGAGCACCATCAGTGCCGTGCAGCAG   1260
ValGluLysLeuArgGlnAsnLeuAsnLysLeuGluSerThrIleSerAlaValGlnGln    420

GTCCTGGAGGAGGGTAGAGCGCTAGACATCCTACTGGCCCGAGACCGGATGCTGGCCCAG   1320
ValLeuGluGluGlyArgAlaLeuAspIleLeuLeuAlaArgAspArgMetLeuAlaGln    440

GTGCAGGAGCTGAAGACCGTGCGGAGCCTCCTGCAGCCCCAGGAAGACGACCGAGTCATG   1380
ValGlnGluLeuLysThrValArgSerLeuLeuGlnProGlnGluAspAspArgValMet    460

TTCACACCCCCCGATCAGGCACTGTACCTTGCCATCAAGTCTTTTGGCTTTGTTAGCAGC   1440
PheThrProProAspGlnAlaLeuTyrLeuAlaIleLysSerPheGlyPheValSerSer    480

GGGGCCTTTGCCCCACTCACCAAGGCCACAGGCGATGGCCTCAAGCGTGCCCTCCAGGGT   1500
GlyAlaPheAlaProLeuThrLysAlaThrGlyAspGlyLeuLysArgAlaLeuGlnGly    500

AAGGTGGCCTCCTTCACAGTCATTGGTTATGACCACGATGGTGAGCCCCGCCTCTCAGGA   1560
LysValAlaSerPheThrValIleGlyTyrAspHisAspGlyGluProArgLeuSerGly    520

GGCGACCTGATGTCGGCTGTGGTCCTGGGCCCTGATGGCAACCTGTTTGGTGCAGAGGTG   1620
GlyAspLeuMetSerAlaValValLeuGlyProAspGlyAsnLeuPheGlyAlaGluVal    540

AGTGATCAGCAGAATGGGACATACGTGGTGAGTTACCGACCCCAGCTGGAGGGTGAGCAC   1680
SerAspGlnGlnAsnGlyThrTyrValValSerTyrArgProGlnLeuGluGlyGluHis    560
```

FIG. 67 (continued from previous page)

```
CTGGTATCTGTGACACTGTGCAACCAGCACATTGAGAACAGCCCTTTCAAGGTGGTGGTC  1740
LeuValSerValThrLeuCysAsnGlnHisIleGluAsnSerProPheLysValValVal   580

AAGTCAGGCCGCAGCTACGTGGGCATTGGGCTCCCGGGCCTGAGCTTCGGCAGTGAGGGT  1800
LysSerGlyArgSerTyrValGlyIleGlyLeuProGlyLeuSerPheGlySerGluGly   600

GACAGCGATGGCAAGCTCTGCCGCCCTTGGGGTGTGAGTGTAGACAAGGAGGGCTACATC  1860
AspSerAspGlyLysLeuCysArgProTrpGlyValSerValAspLysGluGlyTyrIle   620

ATTGTCGCCGACCGCAGCAACAACCGCATCCAGGTGTTCAAGCCCTGCGGCGCCTTCCAC  1920
IleValAlaAspArgSerAsnAsnArgIleGlnValPheLysProCysGlyAlaPheHis   640

CACAAATTCGGCACCCTGGGCTCCCGGCCTGGGCAGTTCGACCGACCAGCCGGCGTGGCC  1980
HisLysPheGlyThrLeuGlySerArgProGlyGlnPheAspArgProAlaGlyValAla   660

TGTGACGCCTCACGCAGGATCGTGGTGGCTGACAAGGACAATCATCGCATCCAGATCTTC  2040
CysAspAlaSerArgArgIleValValAlaAspLysAspAsnHisArgIleGlnIlePhe   680

ACGTTCGAGGGCCAGTTCCTCCTCAAGTTTGGTGAGAAAGGAACCAAGAATGGGCAGTTC  2100
ThrPheGluGlyGlnPheLeuLeuLysPheGlyGluLysGlyThrLysAsnGlyGlnPhe   700

AACTACCCTTGGGATGTGGCGGTGAATTCTGAGGGCAAGATCCTGGTCTCAGACACGAGG  2160
AsnTyrProTrpAspValAlaValAsnSerGluGlyLysIleLeuValSerAspThrArg   720

AACCACCGGATCCAGCTGTTTGGGCCTGATGGTGTCTTCCTAAACAAGTATGGCTTCGAG  2220
AsnHisArgIleGlnLeuPheGlyProAspGlyValPheLeuAsnLysTyrGlyPheGlu   740

GGGGCTCTCTGGAAGCACTTTGACTCCCCACGGGGTGTGGCCTTCAACCATGAGGGCCAC  2280
GlyAlaLeuTrpLysHisPheAspSerProArgGlyValAlaPheAsnHisGluGlyHis   760

TTGGTGGTCACTGACTTCAACAACCACCGGCTCCTGGTTATTCACCCCGACTGCCAGTCG  2340
LeuValValThrAspPheAsnAsnHisArgLeuLeuValIleHisProAspCysGlnSer   780

GCACGCTTTCTGGGCTCGGAGGGCACAGGCAATGGGCAGTTCCTGCGCCCACAAGGGGTA  2400
AlaArgPheLeuGlySerGluGlyThrGlyAsnGlyGlnPheLeuArgProGlnGlyVal   800

GCTGTGGACCAGGAAGGGCGCATCATTGTGGCGGATTCCAGGAACCATCGGGTACAGATG  2460
AlaValAspGlnGluGlyArgIleIleValAlaAspSerArgAsnHisArgValGlnMet   820

TTTGAATCCAACGGCAGCTTCCTGTGCAAGTTTGGTGCTCAAGGCAGCGGCTTTGGGCAG  2520
PheGluSerAsnGlySerPheLeuCysLysPheGlyAlaGlnGlySerGlyPheGlyGln   840
```

FIG. 67 (continued from previous page)

```
ATGGACCGCCCTTCCGGCATCGCCATCACCCCCGACGGAATGATCGTTGTGGTGGACTTT  2580
MetAspArgProSerGlyIleAlaIleThrProAspGlyMetIleValValValAspPhe   860

GGCAACAATCGAATCCTCGTCTTCTAATTGCATTTCCTAGGTTTCTGTGTTTGGGGTGTG  2640
GlyAsnAsnArgIleLeuValPhe***                                   868

TGTGCGTGTCTCTCTCTCTCTCTCTCTTTCTCTTTCTCTCTCTTTTTGAATTTCAAAG    2700
AAGAAACAGTCTCAGGGAAATTTCTTTTTTCTTTTTTTTTTTAAAGAGAACAAGAAAAG   2760
TACAACATTGCTTAAGTCCTACCTCATCTTTATTTTTTACAGATGAATGTACTTATCTT   2820
TTCTGCAGGGATTGAGCCTGTGAAGTGATAATTTCTATCTACCTCATAAATCTTTACATT 2880
TCCTTCTGCAACAGGCCCTCTTCCCCTCCTCAGTGGAGTTTGCATTTCCTCTTCCCCTG  2940
CGTGGGGCATGATATGCACAAGCCTGGCATCTGTATGGCTGGGAGGGCACTGGATGTGTG 3000
TGGTGGGGTGTATTCTGTAGATTGAGCCAAGGAAACACAAAAAAAAACTACTAAGTAAAA 3060
AAACAAAAAACTATAAAACATGGAAAAAATAGGATTTGAAATGCATAATTATAGAATACC 3120
TGTGTTCTTGAGAATACTGTTTATATGGGGTTTAGATTATGTTGTGTTGTTTTGATCTTT 3180
TTGGAAAATCTTCTCTTTTTAAATGCTGCAACAGAGAAATTTCCTCTGTTCTCTGTTTAT 3240
ACCTCTTAATTGTATTGTCCAAGGCAGACATGATATAAGGAATATGCACTACCGTAGTAA 3300
CTCCCCTGGCCGCAGAAACCACACTGCAAGCCTGTCCGGGGTGGGGTGCTGACTGCCATT 3360
TGCCACTTTTAAATGGGCACTGCCGTGGTAATGTGAATCCC                    3401
```

FIG. 67 (continued from previous page)

```
K#1.nuc         1:----------------------------------------------------------- 1
XM_067369.nuc   1:ATGCGCGGACTGACCCAGCGGCCGGCGCGGCGGCGCCGGGCGGACTTAATCGCGGGCGCA 60

K#1.nuc         1:----------------------------------------------------------- 1
XM_067369.nuc  61:GCGCGAGGCTCGGGACCCAGAGCACCACCTACCGGCGGCACGGTCGGCGCAGCAGGCCCC 120

K#1.nuc         1:----------------------------------------------------------- 1
XM_067369.nuc 121:AGAAGGGCGGGGAACGCTGTCAAGCCCAGGGGCACTTCGGCGAGGAGCCCCACCCGCCCT 180

K#1.nuc         1:----------------------------------------------------------- 1
XM_067369.nuc 181:CCAGCTGACCCTCAGCTGTGGCCCACATCCGGGGCCCAGAGCGCCGCGGAAACGCCGAAG 240

K#1.nuc         1:----------------------------------------------------------- 1
XM_067369.nuc 241:CCCGGCCGGCAGATAGCGCGGAAAGCGAAGAAGGAAGTTCCCGTCCCTCCTAAAGCCGAA 300

K#1.nuc         1:----------------------------------------------------------- 1
XM_067369.nuc 301:GCCAAAGCGAAGTCTTTAAAGGCCAAGAAGGCAGTGTTGAAAGGTGTCCGCAGCCACAAA 360

K#1.nuc         1:----------------------------------------------------------- 1
XM_067369.nuc 361:AAAAAGAAGATCCGCACGTCACCCACCTTACGGCGGCCCAAGACACCGCGACTCCGGAGA 420

K#1.nuc         1:-----------CCCTCCTCCGGGCTGGGTTGCAAATGGCTTCGTTCCCCGAGACCGATT 48
                              * ***   * **    *    *    *    ** **   *    *
XM_067369.nuc 421:CAGCCCAAATATC-CTCGGAAGAGCGCTCCTAGGAGAAACAAGCTTGACCACTATGCTAT 479

K#1.nuc        49:TCCAGATCTGCTTGCTGTGCAAGGAGATGTGCGGCTCGCCGGCGCCGCTCTCCTCCAACT 108
                    *  * **    *   * **  ***   *        *    *       *     **
XM_067369.nuc 480:CATCAAGTTTCTGCT-GACCACTGAGTCTGCCATGAAGAAGATAGAAGACAATAACACAC 538

K#1.nuc       109:C-GTCCGCGTCGTCGTCCTCCTCGCAGACGTCCACGTCGTCGGGGGGCGGCGGCGGGGGC 167
                   **   * * ** *   *   ** **  ***   *        *   *  *  *  **
XM_067369.nuc 539:TTGTGTTCATTGTGGATGTTAAAGCCAACAAGCACCAGATTAAACAGGCTGTGAAGAAGC 598

K#1.nuc       168:CCTGGGGCGGCGGCGCGCCGCCTACACGTCCTGCCCTGCCTGCACGCCTTCTGCCGCCCC 227
                   **  * *   * **          *    ** *       * *
XM_067369.nuc 599:TCTATGACAAAGATGTGGTCAAGGTCAACACCCTGATTCGGCCTGATGGAGAGAAGAAGG 658

K#1.nuc       228:TGCCTCGAGGCGCACCGGCTGCCGGCGGCGGGCGGCGGCGCGGCGGGAGAGCCGCTCAAG 287
                   *** *   *  ** ** ** ** *  *   *  **   *         ** *    *
XM_067369.nuc 659:CGCCGCAGCCGCCCGCGCCTTCCCGCTCGGCACCCGGCGGCCCTGCCGCTTCCCCGTCGG 718
```

FIG. 68

```
K#1. nuc         288:CTGCGCTGCCCCGTGTGCGACCAGAAAGTAGTGCTAGCCGAGGCGGCGGGTATGGACGCG 347
                     *  ***** ***       *     * ** * **  * ***     *

XM_067369. nuc   719:CGCTGCTGCTCCGCCGTCCTCACGGCTGCAGCTCGTGCGATGAGGGCAACGCAGCTTCTT 778

K#1. nuc         348:CTGCCTTCGTCCGCCTTCCTGCTTAACAACCTGCTCGACGCGGTGGTGGCCACTGCCGAC 407
                     *   ** ** *   *  * *  **     *         ***  * * ***   **

XM_067369. nuc   779:CGCGCTGCCTCGACTGCCAGGAGCACCTGTGCGACAACTGCGTCCGAGCGCACCAGCGCG 838

K#1. nuc         408:GAGCCGCCGCCCAAGAACGGGCGCGCCGGCGCTCCGGCGGGAGCGGGCGGCCAC-AGCAA 466
                     *  * ** ** *      * **** *      * *     * *    ****

XM_067369. nuc   839:TGCGCCTCACCAAGGACCACTACATCGAGCGCGGCCCGCCGGGTCCCGGTGCCGCAGCAG 898

K#1. nuc         467:CCACCGGCACCACGCTCACCACGCGCACCCGCGCGCGTCCGCCTCCGCGCCGCCACTCCC 526
                     * *     * **  *   * * ***  * ** **  ** * **  *

XM_067369. nuc   899:CGGCGCAG-CAGCTCGGGCTCGGGCCGCCCTTTCCCGGCCCGCCCTTCTCCATCCTCTCA 957

K#1. nuc         527:GCAGGCGCCGCAGCCGCCCGCGCCCTTCCCGCTCGGCACCCGGCGGCCCTGCCGCTTCCCC 586
                     *        ***    *  * **  ** ** **  *  *       *    * * *** *

XM_067369. nuc   958:GTGTTTCCCGAGCGCCTCGGCTTCTGCCAGCACCACGACGACGAGTTGGGGCTTTTCACT 1017

K#1. nuc         587:GTCGGCGCTGCTGCTCCGCCGTCCTCACGGCTGCAGCTCGTGCGATGAGGGCAACGCAG- 645
                     *   **  **  *  *           ****         * * *

XM_067369. nuc  1018:AGTTCTGTGCCTCCAGAGTCCGAAAGGCCTGCAGGCTCCGTGGCCCAGCCGGCATCCGGG 1077

K#1. nuc         646:CTTCTTCGCGCTGCCTCGACTGCCAGGAGCACCTGTGCGACAACTGCGTCCGAGCGCACC 705
                     *        *    * * *   **  *    *    * *** **       *    **

XM_067369. nuc  1078:CGGGGAATCCAAGGCGAGGAATCCGAGGTCGCCGTCCCCGGAACAGCTGGCCGCGGGCCC 1137

K#1. nuc         706:AGCGCGTGCGCCTCACCAAGGACCACTACATCGAGCGCGGCCCGCCGGGTCCCGGTGCCG 765
                     ******     *     *  ** *    *    **  **

XM_067369. nuc  1138:GCTGCGTGCCGCGGGTCCCGGGAGAGGCGGGCGCAGGCTAGAGCAGCAAAGGAAACTTTT 1197

K#1. nuc         766:CAGCAGCGGCGCAGCAGCTCGGGCTCGGGCCGCCCTTTCCCGGCCCGCCCTTCTCCATCC 825
                     * *  *   ** ** ** *        *      *       *        *  ** *

XM_067369. nuc  1198:CTGGTACATTCTTACATCCAGGCCACTAATATCAGACTAGGTAACACAGTCTTAACAACT 1257

K#1. nuc         826:TCTCAGTGTTTCCCGAGCGCCTCGGCTTCTGCCAGCACCACGACGACGAGGTGCTGCACC 885
                     * ** * *                               * *    *  *********

XM_067369. nuc  1258:TTTCTGGATAATGAAGCTAAGATTCAGGGCAAACTCTCATGCCAGGAGG—TGCTGCACC 1315
```

FIG. 68 (continued from previous page)

```
K#1.nuc            886:TGTACTGTGACACTTGCTCTGTACCCATCTGTCGTGAGTGCACAATGGGCCGGCATGGGG 945
                       ************************************************************
XM_067369.nuc    1316:TGTACTGTGACACTTGCTCTGTACCCATCTGTCGTGAGTGCACAATGGGCCGGCATGGGG 1375

K#1.nuc            946:GCCACAGCTTCATCTACCTCCAGGAGGCACTGCAGGACTCACGGGCACTCACCATCCAGC 1005
                       ************************************************************
XM_067369.nuc    1376:GCCACAGCTTCATCTACCTCCAGGAGGCACTGCAGGACTCACGGGCACTCACCATCCAGC 1435

K#1.nuc           1006:TGCTGGCAGATGCCCAGCAGGGACGACAGGCAATCCAGCTGA------------------ 1047
                       *****************************************  *
XM_067369.nuc    1436:TGCTGGCAGATGCCCAGCAGGGACGACAGGCAATCCAGACAAAGCAGAAGAAGCTGCTTC 1495

K#1.nuc           1048:----------GCATCGAGCAGGCCCAGACGGTGGCGGAACAGGTGGAGATGAAGGCGAAGG 1098
                                 ***************************************************
XM_067369.nuc    1496:TGCAGCTGAGCATCGAGCAGGCCCAGACGGTGGCGGAACAGGTGGAGATGAAGGCGAAGG 1555

K#1.nuc           1099:TTGTGCAGTCGGAGGTCAAAGCCGTGACTGCGAGGCATAAGAAAGCCCTGGAGGAACGCG 1158
                       *************************  ********************************
XM_067369.nuc    1556:TTGTGCAGTCGGAGGTCAAAGCCGTGACGGCGAGGCATAAGAAAGCCCTGGAGGAACGCG 1615

K#1.nuc           1159:AGTGTGAGCTGCTGTGGAAGGTAGAAAAGATCCGCCAGGTGAAAGCCAAGTCTCTGTACC 1218
                       ************************************************************
XM_067369.nuc    1616:AGTGTGAGCTGCTGTGGAAGGTAGAAAAGATCCGCCAGGTGAAAGCCAAGTCTCTGTACC 1675

K#1.nuc           1219:TGCAGGTGGAGAAGCTGCGGCAAAACCTCAACAAGCTTGAGAGCACCATCAGTGCCGTGC 1278
                       ************************************************************
XM_067369.nuc    1676:TGCAGGTGGAGAAGCTGCGGCAAAACCTCAACAAGCTTGAGAGCACCATCAGTGCCGTGC 1735

K#1.nuc           1279:AGCAGGTCCTGGAGGAGGGTAGAGCGCTAGACATCCTACTGGCCCGAGACCGGATGCTGG 1338
                       ************************************************************
XM_067369.nuc    1736:AGCAGGTCCTGGAGGAGGGTAGAGCGCTAGACATCCTACTGGCCCGAGACCGGATGCTGG 1795

K#1.nuc           1339:CCCAGGTGCAGGAGCTGAAGACCGTGCGGAGCCTCCTGCAGCCCCAGGAAGACGACCGAG 1398
                       ************************************************************
XM_067369.nuc    1796:CCCAGGTGCAGGAGCTGAAGACCGTGCGGAGCCTCCTGCAGCCCCAGGAAGACGACCGAG 1855

K#1.nuc           1399:TCATGTTCACACCCCCCGATCAGGCACTGTACCTTGCCATCAAGTCTTTTGGCTTTGTTA 1458
                       ************************************************************
XM_067369.nuc    1856:TCATGTTCACACCCCCCGATCAGGCACTGTACCTTGCCATCAAGTCTTTTGGCTTTGTTA 1915
```

FIG. 68 (continued from previous page)

```
K#1. nuc         1459: GCAGCGGGGCCTTTGCCCCACTCACCAAGGCCACAGGCGATGGCCTCAAGCGTGCCCTCC 1518
                       ************************************************************
XM_067369. nuc   1916: GCAGCGGGGCCTTTGCCCCACTCACCAAGGCCACAGGCGATGGCCTCAAGCGTGCCCTCC 1975

K#1. nuc         1519: AGGGTAAGGTGGCCTCCTTCACAGTCATTGGTTATGACCACGATGGTGAGCCCCGCCTCT 1578
                       ************************************************************
XM_067369. nuc   1976: AGGGTAAGGTGGCCTCCTTCACAGTCATTGGTTATGACCACGATGGTGAGCCCCGCCTCT 2035

K#1. nuc         1579: CAGGAGGCGACCTGATGTCGGCTGTGGTCCTGGGCCCTGATGGCAACCTGTTTGGTGCAG 1638
                       ************************************************************
XM_067369. nuc   2036: CAGGAGGCGACCTGATGTCGGCTGTGGTCCTGGGCCCTGATGGCAACCTGTTTGGTGCAG 2095

K#1. nuc         1639: AGGTGAGTGATCAGCAGAATGGGACATACGTGGTGAGTTACCGACCCCAGCTGGAGGGTG 1698
                       ************************************************************
XM_067369. nuc   2096: AGGTGAGTGATCAGCAGAATGGGACATACGTGGTGAGTTACCGACCCCAGCTGGAGGGTG 2155

K#1. nuc         1699: AGCACCTGGTATCTGTGACACTGTGCAACCAGCACATTGAGAACAGCCCTTTCAAGGTGG 1758
                       ************************************************************
XM_067369. nuc   2156: AGCACCTGGTATCTGTGACACTGTGCAACCAGCACATTGAGAACAGCCCTTTCAAGGTGG 2215

K#1. nuc         1759: TGGTCAAGTCAGGCCGCAGCTACGTGGGCATTGGGCTCCCGGGCCTGAGCTTCGGCAGTG 1818
                       ************************************************************
XM_067369. nuc   2216: TGGTCAAGTCAGGCCGCAGCTACGTGGGCATTGGGCTCCCGGGCCTGAGCTTCGGCAGTG 2275

K#1. nuc         1819: AGGGTGACAGCGATGGCAAGCTCTGCCGCCCTTGGGGTGTGAGTGTAGACAAGGAGGGCT 1878
                       ************************************************************
XM_067369. nuc   2276: AGGGTGACAGCGATGGCAAGCTCTGCCGCCCTTGGGGTGTGAGTGTAGACAAGGAGGGCT 2335

K#1. nuc         1879: ACATCATTGTCGCCGACCGCAGCAACAACCGCATCCAGGTGTTCAAGCCCTGCGGCGCCT 1938
                       ************************************************************
XM_067369. nuc   2336: ACATCATTGTCGCCGACCGCAGCAACAACCGCATCCAGGTGTTCAAGCCCTGCGGCGCCT 2395

K#1. nuc         1939: TCCACCACAAATTCGGCACCCTGGGCTCCCGGCCTGGGCAGTTCGACCGACCAGCCGGCG 1998
                       ************************************************************
XM_067369. nuc   2396: TCCACCACAAATTCGGCACCCTGGGCTCCCGGCCTGGGCAGTTCGACCGACCAGCCGGCG 2455

K#1. nuc         1999: TGGCCTGTGACGCCTCACGCAGGATCGTGGTGGCTGACAAGGACAATCATCGCATCCAGA 2058
                       ************************************************************
XM_067369. nuc   2456: TGGCCTGTGACGCCTCACGCAGGATCGTGGTGGCTGACAAGGACAATCATCGCATCCAGA 2515
```

FIG. 68 (continued from previous page)

```
K#1.nuc        2059:TCTTCACGTTCGAGGGCCAGTTCCTCCTCAAGTTTGGTGAGAAAGGAACCAAGAATGGGC 2118
                    ************************************************************
XM_067369.nuc  2516:TCTTCACGTTCGAGGGCCAGTTCCTCCTCAAGTTTGGTGAGAAAGGAACCAAGAATGGGC 2575

K#1.nuc        2119:AGTTCAACTACCCTTGGGATGTGGCGGTGAATTCTGAGGGCAAGATCCTGGTCTCAGACA 2178
                    ************************************************************
XM_067369.nuc  2576:AGTTCAACTACCCTTGGGATGTGGCGGTGAATTCTGAGGGCAAGATCCTGGTCTCAGACA 2635

K#1.nuc        2179:CGAGGAACCACCGGATCCAGCTGTTTGGGCCTGATGGTGTCTTCCTAAACAAGTATGGCT 2238
                    ************************************************************
XM_067369.nuc  2636:CGAGGAACCACCGGATCCAGCTGTTTGGGCCTGATGGTGTCTTCCTAAACAAGTATGGCT 2695

K#1.nuc        2239:TCGAGGGGGCTCTCTGGAAGCACTTTGACTCCCCACGGGGTGTGGCCTTCAACCATGAGG 2298
                    ************************************************************
XM_067369.nuc  2696:TCGAGGGGGCTCTCTGGAAGCACTTTGACTCCCCACGGGGTGTGGCCTTCAACCATGAGG 2755

K#1.nuc        2299:GCCACTTGGTGGTCACTGACTTCAACAACCACCGGCTCCTGGTTATTCACCCCGACTGCC 2358
                    ************************************************************
XM_067369.nuc  2756:GCCACTTGGTGGTCACTGACTTCAACAACCACCGGCTCCTGGTTATTCACCCCGACTGCC 2815

K#1.nuc        2359:AGTCGGCACGCTTTCTGGGCTCGGAGGGCACAGGCAATGGGCAGTTCCTGCGCCCACAAG 2418
                    ************************************************************
XM_067369.nuc  2816:AGTCGGCACGCTTTCTGGGCTCGGAGGGCACAGGCAATGGGCAGTTCCTGCGCCCACAAG 2875

K#1.nuc        2419:GGGTAGCTGTGGACCAGGAAGGGCGCATCATTGTGGCGGATTCCAGGAACCATCGGGTAC 2478
                    ************************************************************
XM_067369.nuc  2876:GGGTAGCTGTGGACCAGGAAGGGCGCATCATTGTGGCGGATTCCAGGAACCATCGGGTAC 2935

K#1.nuc        2479:AGATGTTTGAATCCAACGGCAGCTTCCTGTGCAAGTTTGGTGCTCAAGGCAGCGGCTTTG 2538
                    ************************************************************
XM_067369.nuc  2936:AGATGTTTGAATCCAACGGCAGCTTCCTGTGCAAGTTTGGTGCTCAAGGCAGCGGCTTTG 2995

K#1.nuc        2539:GGCAGATGGACCGCCCTTCCGGCATCGCCATCACCCCCGACGGAATGATCGTTGTGGTGG 2598
                    ************************************************************
XM_067369.nuc  2996:GGCAGATGGACCGCCCTTCCGGCATCGCCATCACCCCCGACGGAATGATCGTTGTGGTGG 3055

K#1.nuc        2599:ACTTTGGCAACAATCGAATCCTCGTCTTCTAATTGCATTTCCTAGGTTTCTGTGTTTGGG 2658
                    ******************************
XM_067369.nuc  3056:ACTTTGGCAACAATCGAATCCTCGTCTTCTAA---------------------------- 3087

K#1.nuc        2659:GTGTGTGTGCGTGTCTCTCTCTCTCTCTCTCTCTTTCTCTTTCTCTCTCTTTTTGAATTT 2718
XM_067369.nuc  3088:------------------------------------------------------------ 3088
```

FIG. 68 (continued from previous page)

```
GTAATTGACAAAGTCACGTGTGCTCAGGGGGCCAGAAACTGGAGAGAGGAGAGAAAAAAA    60
TCAAAAGAAGGAAAGCACATTAGACCATGCGAGCTAAATTTGTGATCGCACAAAATCAAG   120
ATGTTAGATTGATGCAGAAGATCACTCCGTTCCAAAGGGAAAGTTTTCATCTCACGAGTT   180
TGGAGCTGAGGGCCCGTGGGGCAACATGGCCGAAGGCGGGGCTAGCAAAGGTGGTGGAGA   240
                        MetAlaGluGlyGlyAlaSerLysGlyGlyGlyGlu    12

AGAGCCCGGGAAGCTGCCGGAGCCGGCAGAGGAGGAATCCCAGGTTTTGCGCGGAACTGG   300
  GluProGlyLysLeuProGluProAlaGluGluGluSerGlnValLeuArgGlyThrGly    32

CCACTGTAAGTGGTTCAATGTGCGCATGGGATTTGGATTCATCTCCATGATAAACCGAGA   360
  HisCysLysTrpPheAsnValArgMetGlyPheGlyPheIleSerMetIleAsnArgGlu    52

GGGAAGCCCCTTGGATATTCCAGTCGATGTATTTGTACACCAAAGCAAACTATTCATGGA   420
  GlySerProLeuAspIleProValAspValPheValHisGlnSerLysLeuPheMetGlu    72

AGGATTTAGAAGCCTAAAAGAAGGAGAACCAGTGGAATTCACATTTAAAAAATCTTCCAA   480
  GlyPheArgSerLeuLysGluGlyGluProValGluPheThrPheLysLysSerSerLys    92

AGGCCTTGAGTCAATACGGGTAACAGGACCTGGTGGGAGCCCCTGTTTAGGAAGTGAAAG   540
  GlyLeuGluSerIleArgValThrGlyProGlyGlySerProCysLeuGlySerGluArg   112

AAGACCCAAAGGGAAGACACTACAGAAAAGAAAACCAAAGGGAGATAGATGCTACAACTG   600
  ArgProLysGlyLysThrLeuGlnLysArgLysProLysGlyAspArgCysTyrAsnCys   132

TGGTGGCCTTGATCATCATGCTAAGGAATGTAGTCTACCTCCTCAGCCAAAGAAGTGCCA   660
  GlyGlyLeuAspHisHisAlaLysGluCysSerLeuProProGlnProLysLysCysHis   152

TTACTGTCAGAGCATCATGCACATGGTGGCAAACTGCCCACATAAAAATGTTGCACAGCC   720
  TyrCysGlnSerIleMetHisMetValAlaAsnCysProHisLysAsnValAlaGlnPro   172

ACCCGCGAGTTCTCAGGGAAGACAGGAAGCAGAATCCCAGCCATGCACTTCAACTCTCCC   780
  ProAlaSerSerGlnGlyArgGlnGluAlaGluSerGlnProCysThrSerThrLeuPro   192

TCGAGAAGTGGGAGGCGGGCATGGCTGTACATCACCACCGTTTCCTCAGGAGGCTAGGGC   840
  ArgGluValGlyGlyGlyHisGlyCysThrSerProProPheProGlnGluAlaArgAla   212

AGAGATCTCAGAACGGTCAGGCAGGTCACCTCAAGAAGCTTCCTCCACGAAGTCATCTAT   900
  GluIleSerGluArgSerGlyArgSerProGlnGluAlaSerSerThrLysSerSerIle   232

AGCACCAGAAGAGCAAAGCAAAAGGGGCCTTCAGTTCAAAAAAGGAAAAAGACATAACA   960
  AlaProGluGluGlnSerLysLysGlyProSerValGlnLysArgLysLysThr***     250
```

FIG. 70

```
GGTCTTCTTCATATGTTCTTTCCTTTACCCGGTTGCAAAGTCTACCTCATGCAAGTATAG    1020
GGGAACAGTATTTCACAAGCAGTAGCTGACCTGGGATTTTAACTACTATTGGGGAACTGT    1080
GAATTTTTTAAACAGACAAATCACTCTAAGCAAATTACATTTGAGCAGGGTGTCATGTTT    1140
TATGTTAATTCAGAGAATAAGATACTATGTCTGTCAATATGTGCATGTGTGAGAGGGAGA    1200
GAGCCTGAGTCTGTGTGTGTACATGAGGATTTTTATATAGGAATGTAGACACATATATAA    1260
AGAGGCTTTGTCTTTATATATTTGTGTATAGATCAAAGCACACACCCTCTCTCATATAAT    1320
TGGATATTTCCAAGAATTGAAAACCCATGTGAAGCATTATAGATAGTTTTAAATTTAACC    1380
CACTGGAGTTTTCTTGAAATACCACTTCTTTTATATTATATAAAACTAAAAACACGACTG    1440
TTACCTTTTGTGTGAACCAAAGGATACTTCAGATCTCAGAGCTGCCAATTATGGGGTACT    1500
AAAGGTTTTTAAGACATCCAGTTCTCCCGAATTTGGGATTGCCTCTTTTCTTGAAATCT    1560
CTGGAGTAGTAATTTTTTTCCCCCTTTTTTGAAGGCAGTACCTTAACTTCATATGCCTCT    1620
GACTGCCATAAGCTTTTTTGATTCTGGGATAACATAACTCCAGAAAAGACAATGAATGTG    1680
TAATTTGGGCCGATATTTCACTGTTTTAAATTCTGTGTTAATTGTAAAATTAGATGCCT    1740
ATTAAGAGAAATGAAGGGGAGGATCATCTTAGTGGCTTGTTTTCAGTAGTATTTTAATAT    1800
CAGCTTCTTGTAACCTTTTCCATGTTGTGAGGGTTGTAAGGGATTGTGTGGCAACAGCAG    1860
CTTCCCTTGGCTAACTCAATCTTCTACCCATTGCTTAGAGCAGGGAGCCCTCCTTATTTA    1920
CTACTGAAGACCTTAGAGAACTCCAATTGTTTGGCATATATTTTTGGTGGTGGTTTTTAT    1980
TCCTCCTGGAGAGTTATCTAATTTGTTTCTAAACAAACAAGCAGCAAAGAAATGAATTA    2040
AATACTGGGGTTGAGAATTAAAATTAAGTGGATGTTCACAGTTGCCCAATATATATGACC    2100
TGCAAATGATACGAAAAGTGCAGCATTTAGTGGCAGTTAACAAGAGTGACAAGCCTGGG    2160
GCAGAGGTACCAAACCTCTCCCACCAGAGAGCTAGAAGTATTTTATACAGTAACTTTGAT    2220
CTTATGGAAGTGACCTTCAATGCTTATTCTGAAGTAACCTATATGGTGGATACAGGATGA    2280
ACATTCAGTGCCAGGGAGAATCTTCTCAGGTTGGTTCTCGTTAGAGTGATAAACTGGCTA    2340
GGGGCCATAGTATTGGTCCTGTTAGGTTTCGGTCATGGAAAAAAAATTATTTTGGGGTC    2400
ATCCTGGCTCTAGATGTTATGGGCAAATTTCTGAAACATCTGCAAGAAGGTACCAGTTAA    2460
TTATAGTGCTTAATATTGGGAATAAGATTAAGCATTATAATTATAATGTATGGGCCTGTT    2520
GGTGTAAGCTCAGATAATTAAATAAAAATAGCATGACTCAAATGAGACATATTCTGCTGA    2580
ACAGTTTCTACTTCCTCTCCCGCCTGTCCTGTCATGGGAGACGTGTATAGTTGCTGCTGT    2640
TTCAGCAAACCACCATAAGACGAAAATGCCTCAGGTTGGGTTGCCAGTCCTTTACAACTC    2700
AGCTTGAATTTCACAACAGTGATTGTGAGAATCTGCGTGGTATACACTGAAATATCGGTG    2760
TGCTGTGATGCAAAGCTTACCTTTGACGATATTGAATGTGATATAGCTGTAGAGAAGTAC    2820
TTCCTTGCCTTATGTGAGGATTTCAAACTTATTTAAATTATGTAGACAAATCAAAGTGGC    2880
ATTGCTTAATTTTTAGCAGGCATAATAAGCAAGTTAACAGTAAAATGCAAAACATGATAA    2940
GCGTTGCTCAATTTTTAGCAGGTATAATAAGCAGGTTAACAGTAAAAATGCAAAACATGA    3000
TAGATAAGTCACTTTGAAAATTCAAACCAAAGTTCCTTCACCTTATGGAAATAGGAAATT    3060
ATGGACTTCAAAATTGGACACTTCCTGTTTACAAAAGAAATTCAGAGCTAAAATCATGG    3120
TAAAAAAAATAGAAACACTTGAGAACTATGGTCTTTATGGGTGCAATTTGAAATCCTTT    3180
TCATCATCTTACCAGACTAAACTAAGAGCACATACCAAACCTATCTTATGGTTGAAAGTT    3240
GGGGTTTATTTTTTATATGAGAATATTATCACTATTACATAACATACTCAGGACAAAGAA    3300
CTTTGCTCAGGGAACATACCATGTAATATTTTGTTGTTTCTTTACAGACTAGTCTACAG    3360
TCCTGCTTACTCAAAACAAACCAAATAACTTATACCTTTATATAAGTATTATGTACTGAT    3420
```

FIG. 70 (continued from previous page)

```
GATAGTAACTACCTCTGAGTTTGACACAGATCAAAATTTTTGAATATCAGATATCAGTTA  3480
TCCTATTTTTATTTCATGTGAAAACTCCTCTAAAGCAGATTCCCTCAACTCTGTGCATAT  3540
GTGAATATCACTGATGTGAACACATTGTTCATTTACATAGGTAAAATATTACTCTGTTTA  3600
CAGCAAAAGGCTACCTCATAGTTGATACATAGCACACCTGTATGTATGCTGTTCCAGCCT  3660
TACAGGTGGCTGATAATTCTCTGGTACAGAACCTTTTTATCTGTATTATAAATAGCAATT  3720
CACAACTGCATGTTTCTGACAAACACTTGTGAATAATGAAGCATCTCGTTTTAGTTAGCA  3780
AAGTCTCCAAACATTTCCTTAAAATAATCATGTATTTAGTTTAAAGAATTATGGGCACTG  3840
TTCAACTTAAGCAAAACAGAACACGGAAGCAGTCTTAGAAGCACCACTTTGCCCAGAGGT  3900
GGAGGTTGGAAGGGGTAGCAGGGAGAGGGGTTGGTGTATGCAGGTATTCATGCTAGGCAA  3960
AGAGTTTAAAAGACGCCAATGTCCTTCATTTACTGTCTGTGCTGCCCTGAAGCCAAGCGT  4020
ATTGCAGCATTATAGCCCCAGGCACATAACTAACTAGCACTGGCTTGCCAAGGAATGAAC  4080
ATGCAATGCCATTACTAGCTATTGAGGGAAAAGGGTCTGTGTGAAGCATCACTTTGCAGG  4140
GATTACTAATGGTGGGGCAGCAGGTCTGTGAATTAAGTTATCTCTTGACCTCACCCTCAT  4200
GTCAACACAAATGTAATTCCTAAACAAGATGCATTGCCAGTCTCTTAGCCCTGTAAGCTG  4260
ATCTTTTGCTACATGGCAGACTATAATGAAAACATTTTTATACTTGGGTTTCTAGTCTTC  4320
ACTAGAAGGCCTTGGATGTATTTTTGCAGTTGAAAGATTTAGAAAGATTTTTACCTGCTT  4380
ATAACTTGGAAGTTTAGAGTGCAATGTAAGAAAAAAGATCAAGAAATGTCATGTTATTAG  4440
CATCAGTCCACCTCCAATATTGCCGATACTTTTTTATTCTGGCTCAGTTTTATTTTGCA  4500
CCAGTGCGGCCCCAAGTTACTGCTGGTTGTATTTAGTTTGTGAATAGGAGCCCATAAGTG  4560
TTAATAGACTTTGTAACATTCACTATAAGATGAATTATACAGGACATGGGAAATCTCATT  4620
AAGTCTTAAAGTTAATTTAAATTAATTTATCTGTTTTCTCTAAGAAATGTTTATCATAAA  4680
ATATATATGTGTATTTCCCCTTTGGTTATAAAATTTGGGAAAGTATGTACAAGTGCAGCT  4740
GCACTGACTTTAATTTTCTAGATGTCTTAATGAGATTTATTTGTTTTAGAGAAGAACATC  4800
TTGTTAAAAGCATCAAACTCTGTCTTACATAGCTGTCAACAGCCTCTTTAAGATGTGGTG  4860
GTTGTATGATCTGTGTCTTAATTGTTCAGTTAGAGTGAGAAGTTGACCTATGATTCATTT  4920
TTAAATTTTATATTTGGAACAAAGCTGCAAGTTATGGTAAAGTACTGTACTGTGAGAAGT  4980
ATTATGATATTTAATGCATCTGTGGCTTAACACTTGTGAGAGTTACCAGCTTGAAAATGA  5040
TGGTGTTGACTACCTCTTGAATCACATCTATCAACCACTGGCACCTACCACCAAGCTGGC  5100
TTCAATTAGTATGTGTTGCTTTTTGGTATTAACAACTAACCGTACTAGAGACCAAAGTGA  5160
ACCCTGATTTTTATATGTCTTTAATAATGGTGTTTTATCTAGTGTTTTTAAATTATCCTG  5220
TGTAGTATTTAGATTACCTCATTGTCCATTTGACTCATGTTGTTTACAAGTGAAAATAA  5280
AAACACTTGAACTGTATGTTTTAAAAGACAAAAAAGGGGTAGATGTTTGGAATGCGTTT  5340
CACTCGCATGCAGTCATCTGGAGGGACTGAAGCACTGTTTGCCTTTCTGTACACTCTGGG  5400
TTTTATATTCTCATTTCATGCCTAATGTCTTATTCTGTCAATTATGGATATGTTGAGGTT  5460
TAAAAAAATTACTTGATTAAAAATAAAACATATAACGTTGGCATTTAAAAAAAAAAAAA  5520
AAAAAAAAAAAAAAAAAAAAA                                         5542
```

```
AGTAGCTCTAAACCATCTTCACGATTTCTCTTTCCTCCTCGTGCCCGCCGGAGAGAATAG      60
TTTCGCTGAAAATTTCTCTTTGTCAATGGGATCAGTATTAAATCAGCAATATACAAGTAA     120
AGTATCGCATGCTGTAATGTAAAATGTGGCTGAAAAATGGAGTTAAATGAATAAGTACAC     180
GCGGGGCTAGCAAAGGTGGTGGAGAAGAGCCCGGGAAGCTGCCGGAGCCGGCAGAGGAGG     240
AATCCCAGGTTTTGCGCGGAACTGGCCACTGTAAGTGGTTCAATGTGCGCATGGGATTTG     300
                                                MetGlyPheGly       4

GATTCATCTCCATGATAAACCGAGAGGGAAGCCCCTTGGATATTCCAGTCGATGTATTTG     360
    PheIleSerMETIleAsnArgGluGlySerProLeuAspIleProValAspValPheVal   24

TACACCAAAGCAAACTATTCATGGAAGGATTTAGAAGCCTAAAAGAAGGAGAACCAGTGG     420
    HisGlnSerLysLeuPheMETGluGlyPheArgSerLeuLysGluGlyGluProValGlu    44

AATTCACATTTAAAAAATCTTCCAAAGGCCTTGAGTCAATACGGGTAACAGGACCTGGTG     480
    PheThrPheLysLysSerSerLysGlyLeuGluSerIleArgValThrGlyProGlyGly    64

GGAGCCCCTGTTTAGGAAGTGAAAGAAGACCCAAAGGGAAGACACTACAGAAAAGAAAAC     540
    SerProCysLeuGlySerGluArgArgProLysGlyLysThrLeuGlnLysArgLysPro    84

CAAAGGGAGATAGATGCTACAACTGTGGTGGCCTTGATCATCATGCTAAGGAATGTAGTC     600
    LysGlyAspArgCysTyrAsnCysGlyGlyLeuAspHisHisAlaLysGluCysSerLeu   104

TACCTCCTCAGCCAAAGAAGTGCCATTACTGTCAGAGCATCATGCACATGGTGGCAAACT     660
    ProProGlnProLysLysCysHisTyrCysGlnSerIleMETHisMETValAlaAsnCys   124

GCCCACATAAAAATGTTGCACAGCCACCCGCGAGTTCTCAGGGAAGACAGGAAGCAGAAT     720
    ProHisLysAsnValAlaGlnProProAlaSerSerGlnGlyArgGlnGluAlaGluSer   144

CCCAGCCATGCACTTCAACTCTCCCTCGAGAAGTGGGAGGCGGGCATGGCTGTACATCAC     780
    GlnProCysThrSerThrLeuProArgGluValGlyGlyGlyHisGlyCysThrSerPro   164

CACCGTTTCCTCAGGAGGCTAGGGCAGAGATCTCAGAACGGTCAGGCAGGTCACCTCAAG     840
    ProPheProGlnGluAlaArgAlaGluIleSerGluArgSerGlyArgSerProGlnGlu   184

AAGCTTCCTCCACGAAGTCATCTATAGCACCAGAAGAGCAAAGCAAAAAGGGGCCTTCAG     900
    AlaSerSerThrLysSerSerIleAlaProGluGluGlnSerLysLysGlyProSerVal   204

TTCAAAAAAGGAAAAAGACATAACAGGTCTTCTTCATATGTTCTTTCCTTTACCCGGTTG     960
    GlnLysArgLysLysThr***                                          210
```

FIG. 71

```
CAAAGTCTACCTCATGCAAGTATAGGGGAACAGTATTTCACAAGCAGTAGCTGACCTGGG    1020
ATTTTAACTACTATTGGGGAACTGTGAATTTTTAAACAGACAAATCACTCTAAGCAAAT    1080
TACATTTGAGCAGGGTGTCATGTTTTATGTTAATTCAGAGAATAAGATACTATGTCTGTC   1140
AATATGTGCATGTGTGAGAGGGAGAGAGCCTGAGTCTGTGTGTGTACATGAGGATTTTA    1200
TATAGGAATGTAGACACATATATAAAGAGGCTTTGTCTTTATATATTTGTGTATAGATCA   1260
AAGCACACACCCTCTCTCATATAATTGGATATTTCCAAGAATTGAAAACCCATGTGAAGC   1320
ATTATAGATAGTTTTAAATTTAACCCACTGGAGTTTTCTTGAAATACCACTTCTTTTATA   1380
TTATATAAAACTAAAAACACGACTGTTACCTTTTGTGTGAACCAAAGGATACTTCAGATC   1440
TCAGAGCTGCCAATTATGGGGTACTAAAGGTTTTTAAGACATCCAGTTCTCCCGAATTTG   1500
GGATTGCCTCTTTTTCTTGAAATCTCTGGAGTAGTAATTTTTTCCCCCTTTTTTGAAGG   1560
CAGTACCTTAACTTCATATGCCTCTGACTGCCATAAGCTTTTTGATTCTGGGATAACAT    1620
AACTCCAGAAAAGACAATGAATGTGTAATTTGGGCCGATATTTCACTGTTTTAAATTCTG   1680
TGTTTAATTGTAAAATTAGATGCCTATTAAGAGAAATGAAGGGGAGGATCATCTTAGTGG   1740
CTTGTTTTCAGTAGTATTTTAATATCAGCTTCTTGTAACCTTTTCCATGTTGTGAGGGTT   1800
GTAAGGGATTGTGTGGCAACAGCAGCTTCCCTTGGCTAACTCAATCTTCTACCCATTGCT   1860
TAGAGCAGGGAGCCCTCCTTATTTACTACTGAAGACCTTAGAGAACTCCAATTGTTTGGC   1920
ATATATTTTTGGTGGTGGTTTTATTCCTCCTGGAGAGTTATCTAATTTGTTTCTAAAAC    1980
AAACAAGCAGCAAAGAAATGAATTAAATACTGGGGTTGAGAATTAAAATTAAGTGGATGT   2040
TCACAGTTGCCCAATATATATGACCTGCAAATGATACGAAAAAGTGCAGCATTTAGTGGC   2100
AGTTAACAAGAGTGACAAGCCTGGGGCAGAGGTACCAAACCTCTCCCACCAGAGAGCTAG   2160
AAGTATTTTATACAGTAACTTTGATCTTATGGAAGTGACCTTCAATGCTTATTCTGAAGT   2220
AACCTATATGGTGGATACAGGATGAACATTCAGTGCCAGGGAGAATCTTCTCAGGTTGGT   2280
TCTCGTTAGAGTGATAAACTGGCTAGGGGCCATAGTATTGGTCCTGTTAGGTTTCGGTCA   2340
TGGAAAAAAAATTATTTGGGGTCATCCTGGCTCTAGATGTTATGGGCAAATTTCTGAA    2400
ACATCTGCAAGAAGGTACCAGTTAATTATAGTGCTTAATATTGGGAATAAGATTAAGCAT   2460
TATAATTATAATGTATGGGCCTGTTGGTGTAAGCTCAGATAATTAAATAAAAATAGCATG   2520
ACTCAAATGAGACATATTCTGCTGAACAGTTTCTACTTCCTCTCCGCCTGTCCTGTCAT    2580
GGGAGACGTGTATAGTTGCTGCTGTTTCAGCAAACCACCATAAGACGAAAATGCCTCAGG   2640
TTGGGTTGCCAGTCCTTTACAACTCAGCTTGAATTTCACAACAGTGATTGTGAGAATCTG   2700
CGTGGTATACACTGAAATATCGGTGTGCTGTGATGCAAAGCTTACCTTTGACGATATTGA   2760
ATGTGATATAGCTGTAGAGAAGTACTTCCTTGCCTTATGTGAGGATTTCAAACTTATTTA   2820
AATTATGTAGACAAATCAAAGTGGCATTGCTTAATTTTTAGCAGGCATAATAAGCAAGTT   2880
AACAGTAAAATGCAAAACATGATAAGCGTTGCTCAATTTTTAGCAGGTATAATAAGCAGG   2940
TTAACAGTAAAAATGCAAAACATGATAGATAAGTCACTTTGAAAATTCAAACCAAAGTTC   3000
CTTCACCTTATGGAAATAGGAAATTATGGACTTCAAAATTGGACACTTCCTGTTTACAAA   3060
AAGAAATTCAGAGCTAAAATCATGGTAAAAAAAAATAGAAACACTTGAGAACTATGGTCT   3120
TTATGGGTGCAATTTGAAATCCTTTTCATCATCTTACCAGACTAAACTAAGAGCACATAC   3180
CAAACCTATCTTATGGTTGAAAGTTGGGGTTTATTTTTTATATGAGAATATTATCACTAT   3240
TACATAACATACTCAGGACAAAGAACTTTGCTCAGGGAACATACCATGTAATATTTTTGT   3300
TGTTTCTTTACAGACTAGTCTACAGTCCTGCTTACTCAAAACAAACCAAATAACTTATAC   3360
CTTTATATAAGTATTATGTACTGATGATAGTAACTACCTCTGAGTTTGACACAGATCAAA   3420
ATTTTTGAATATCAGATATCAGTTATCCTATTTTTATTTCATGTGAAAACTCCTCTAAAG   3480
```

FIG. 71 (continued from previous page)

```
CAGATTCCCTCAACTCTGTGCATATGTGAATATCACTGATGTGAACACATTGTTCATTTA      3540
CATAGGTAAAATATTACTCTGTTTACAGCAAAAGGCTACCTCATAGTTGATACATAGCAC      3600
ACCTGTATGTATGCTGTTCCAGCCTTACAGGTGGCTGATAATTCTCTGGTACAGAACCTT      3660
TTTATCTGTATTATAAATAGCAATTCACAACTGCATGTTTCTGACAAACACTTGTGAATA      3720
ATGAAGCATCTCGTTTTAGTTAGCAAAGTCTCCAAACATTTCCTTAAAATAATCATGTAT      3780
TTAGTTTAAAGAATTATGGGCACTGTTCAACTTAAGCAAAACAGAACACGGAAGCAGTCT      3840
TAGAAGCACCACTTTGCCCAGAGGTGGAGGTTGGAAGGGGTAGCAGGGAGAGGGTTGGT      3900
GTATGCAGGTATTCATGCTAGGCAAAGAGTTTAAAAGACGCCAATGTCCTTCATTTACTG      3960
TCTGTGCTGCCCTGAAGCCAAGCGTATTGCAGCATTATAGCCCCAGGCACATAACTAACT      4020
AGCACTGGCTTGCCAAGGAATGAACATGCAATGCCATTACTAGCTATTGAGGGAAAAGGG      4080
TCTGTGTGAAGCATCACTTTGCAGGGATTACTAATGGTGGGCAGCAGGTCTGTGAATTA      4140
AGTTATCTCTTGACCTCACCCTCATGTCAACACAAATGTAATTCCTAAACAAGATGCATT      4200
GCCAGTCTCTTAGCCCTGTAAGCTGATCTTTTGCTACATGGCAGACTATAATGAAAACAT      4260
TTTTATACTTGGGTTTCTAGTCTTCACTAGAAGGCCTTGGATGTATTTTGCAGTTGAAA      4320
GATTTAGAAAGATTTTTACCTGCTTATAACTTGGAAGTTTAGAGTGCAATGTAAGAAAAA      4380
AGATCAAGAAATGTCATGTTATTAGCATCAGTCCACCTCCAATATTGCCGATACTTTTT      4440
TATTCTGGCTCAGTTTTATTTTGCACCAGTGCGGCCCCAAGTTACTGCTGGTTGTATTTA      4500
GTTTGTGAATAGGAGCCCATAAGTGTTAATAGACTTTGTAACATTCACTATAAGATGAAT      4560
TATACAGGACATGGGAAATCTCATTAAGTCTTAAAGTTAATTTAAATTAATTTATCTGTT      4620
TTCTCTAAGAAATGTTTATCATAAAATATATATGTGTATTTCCCCTTTGGTTATAAAATT      4680
TGGGAAAGTATGTACAAGTGCAGCTGCACTGACTTTAATTTTCTAGATGTCTTAATGAGA      4740
TTTATTTGTTTTAGAGAAGAACATCTTGTTAAAAGCATCAAACTCTGTCTTACATAGCTG      4800
TCAACAGCCTCTTTAAGATGTGGTGGTTGTATGATCTGTGTCTTAATTGTTCAGTTAGAG      4860
TGAGAAGTTGACCTATGATTCATTTTTAAATTTTATATTTGGAACAAAGCTGCAAGTTAT      4920
GGTAAAGTACTGTACTGTGAGAAGTATTATGATATTTAATGCATCTGTGGCTTAACACTT      4980
GTGAGAGTTACCAGCTTGAAAATGATGGTGTTGACTACCTCTTGAATCACATCTATCAAC      5040
CACTGGCACCTACCACCAAGCTGGCTTCAATTAGTATGTGTTGCTTTTGGTATTAACAA      5100
CTAACCGTACTAGAGACCAAAGTGAACCCTGATTTTTATATGTCTTTAATAATGGTGTTT      5160
TATCTAGTGTTTTTAAATTATCCTGTGTAGTATTTAGATTACCTCATTGTCCATTTTGAC      5220
TCATGTTGTTTACAAGTGAAAATAAAAACACTTGAACTGTATGTTTTTAAAAGACAAAAA      5280
AGGGGTAGATGTTTGGAATGCGTTTCACTCGCATGCAGTCATCTGGAGGGACTGAAGCAC      5340
TGTTTGCCTTTCTGTACACTCTGGGTTTTATATTCTCATTTCATGCCTAATGTCTTATTC      5400
TGTCAATTATGGATATGTTGAGGTTTAAAAAAATTACTTGATTAAAAATAAAACATATAA      5460
CGTTGGCATTTAAAAAAAAAAAAAAAAAAAAAAAAAAAAAAAAAAAAA                  5507
```

FIG. 71 (continued from previous page)

| | | |
|---|---|---|
| Human K#2 | 1:--------------------MAEGGASKGGGEEPGKLPEPAEEESQVLRGTGHCKWFNVRMG | 42 |
| Human | 1:------------MGSVSNQQFAGGCAKAAEEAPEEAPEDAARAADEPQLLHGAGICKWFNVRMG | 52 |
| Mouse | 1:------------MGSVSNQQFAGGCAKAAEKAPEEAPPDAARAADEPQLLHGAGICKWFNVRMG | 52 |
| Xenopus | 1:------------------MGSVSNQEITEGLPKSLDGTADIHKSDKSVIFQGSGVCKWFNVRMG | 46 |
| Drosophila | 1:--------------MENVQLENGLERRTTSQSSTSSANPANLASPTEECGCVRLGKCKWFNVAKG | 51 |
| C.elegans | 1:MSTVVSEGRNDGNNRYSPQDEVEDRLPDVVDNRLTENMRVPSFERLPSPTPRYFGSCKWFNVSKG | 65 |

| | | |
|---|---|---|
| Human K#2 | 43:FGFISMINREGSPLDIPVDVFVHQSKLFMEGFRSLKEGEPVEFTFKK--SSKGLESIRVTGP-GG | 105 |
| Human | 53:FGFLSMTARAGVALDPPVDVFVHQSKLHMEGFRSLKEGEAVEFTFKK--SAKGLESIRVTGP-GG | 115 |
| Mouse | 53:FGFLSMTARAGVALDPPVDVFVHQSKLHMEGFRSLKEGEAVEFTFKK--SAKGLESIRVTGP-GG | 115 |
| Xenopus | 47:FGFLTMTKKEGTDLETPLDVFVHQSKLHMEGFRSLKEGESVEFTFKK--SSKGLESTQVTGP-GG | 109 |
| Drosophila | 52:WGFLTPN--DGGQ-----EVFVHQSVIQMSGFRSLGEQEEVEFECQR---TSRGLEATRVSSR-HG | 107 |
| C.elegans | 66:YGFVIDD-------ITGEDLFVHQSNLNMQGFRSLDEGERVSYYIQERSNGKGREAYAVSGEVEG | 124 |

Cold shock domain (CSD)

| | | |
|---|---|---|
| Human K#2 | 106:SPCLGSERRPKGKTLQKRKPKGDRCYNCGGLD-HHAKECS-LPPQPKKCHYCQSIMHMVANCPHK | 167 |
| Human | 116:VFCIGSERRPKGKSMQKRRSKGDRCYNCGGLD-HHAKECK-LPPQPKKCHFCQSISHMVASCPLK | 177 |
| Mouse | 116:VFCIGSERRPKGKNMQKRRSKGDRCYNCGGLD-HHAKECK-LPPQPKKCHFCQSINHMVASCPLK | 177 |
| Xenopus | 110:APCIGSERRPKVKGQQKRRQRGDRCYNCGGLD-HHAKECK-LPPQPKKCHFCQNPNHMVAQCPEK | 171 |
| Drosophila | 108:GSCQGSTYRPRI---NRRTRRM-RCYNCGEFANHIASECA-LGPQPKRCHRCRGEDHLHADCPHK | 166 |
| C.elegans | 125:QGLKGSRIHPLG---RKKAVSL-RCFRCGKFATHKAKSCPNVKTDAKVCYTCGSEEHVSSICPER | 184 |

Zinc finger domain

| | | |
|---|---|---|
| Human K#2 | 168:NVAQPPASSQGRQEAESQPCTSTLPREVGGGHGCTSPPFPQEARAEISERSGRSPQEASSTKSSI | 232 |
| Human | 178:AQQGPSAQGKPTYFREEEEEIHSPTLLPEAQN | 209 |
| Mouse | 178:AQQGPSSQGKPAYF | 191 |
| Xenopus | 172:AMQAANLEDQPITEEQELIPEIME | 195 |
| Drosophila | 167:NVTQSHSNSKSISNNSSSSAAQEKSEEAT | 195 |
| C.elegans | 185:RRKHRPEQVAAEEAEAARMAAEKSSPTTSDDDIREKNSNSSDE | 227 |

| | | |
|---|---|---|
| Human K#2 | 233:APEEQSKKGPSVQKRKKT | 250 |

FIG. 72

GENE OVEREXPRESSED IN CANCER

CROSS-REFERENCE TO RELATED PATENT APPLICATIONS

This is a continuation of U.S. patent application Ser. No. 11/584,793, filed on Oct. 20, 2006, which is a continuation of U.S. patent application Ser. No. 10/568,471, filed Feb. 8, 2006 as a national stage filing under 35 U.S.C. §371 of International Application No. PCT/JP2004/011650, filed on Aug. 6, 2004, the entire disclosure of which is hereby incorporated by reference.

TECHNICAL FIELD

The present invention relates to a cancer-associated gene, a protein encoded by the gene, and an antibody recognizing this protein. The gene, protein and antibody of the present invention can be used in diagnosis and treatment of cancer and development of a therapeutic drug of cancer.

BACKGROUND ART

Heretofore, a number of genes have been found whose expression level changes as being associated with malignant transformation of cells and antigens that can be used as a cancer marker, and numerous studies on such genes have been carried out. However, it is still difficult to specifically detect or treat a specific cancer. Therefore, in this technical field, identification of another cancer-associated gene or protein that can be used in diagnosis and treatment of cancer has been demanded.

There are prior art documents related to the present invention: EP 1033401; US 2002022248; US 2002042096; US 200208150; U.S. Pat. Nos. 6,337,195; 6,362,321; WO 9738098; WO 9920764; WO 9929729; WO 0006698; WO 0012702; WO 0034477; WO 0036107; WO 0037643; WO 0055174; WO 0055320; WO 0055351; WO 0055633; WO 0058473; WO 0073509; WO 6100828; WO 0109317; WO 0121653; WO 0122920; WO 0151513; WO 0151628; WO 0154733; WO 0155355; WO 0157058; WO 0159111; WO 0160860; WO 0164835; WO 0164886; WO 0166719; WO 0170976; WO 0173027; WO 6175177; WO 0177168; WO 0192578; WO 0194629; WO 0200677; WO 0200889; WO 0200939; WO 0204514; WO 0210217; WO 0212280; WO 0220598; WO 0229086; WO 0229103; WO 0258534; WO 0260317; and WO 0264797.

An object of the present invention is to provide a gene and a protein that can be used as an agent for diagnosing and treating cancer.

DISCLOSURE OF THE INVENTION

The present inventors have found that the expression of specific genes is elevated in a cancer tissue, and have completed the present invention. The present invention provides a protein encoded by a gene having a nucleotide sequence represented by any of SEQ ID NOs: 1 to 65 or a fragment thereof.

In one aspect, the present invention provides a gene having a nucleotide sequence represented by any of SEQ ID NOs: 1, 2, 28, 29, 30, 31, 32, 51, 52, 60 and 61, a protein encoded by the gene or a fragment thereof. The gene preferably has a nucleotide sequence represented by any of SEQ ID NOs: 1, 2, 28, 29, 30, 31 and 32, more preferably has a nucleotide sequence represented by SEQ ID NO: 1 or 2.

Such a protein or a fragment is useful as a composition for diagnosing or treating lung cancer.

In another aspect, the present invention provides a gene having a nucleotide sequence represented by any of SEQ ID NOs: 3, 4, 5, 6, 7, 8, 9, 10, 11, 12, 13, 22, 23, 24, 25, 26, 27, 33, 34, 35, 36, 37, 38, 39, 40, 41, 42, 53, 54 and 55, a protein encoded by the gene or a fragment thereof. The gene preferably has a nucleotide sequence represented by any of SEQ ID NOs: 3, 4, 5, 6, 7, 8, 9, 10, 11, 12, 13, 22, 23, 24, 25 and 26.

Such a protein or a fragment is useful as a composition for diagnosing or treating stomach cancer.

In another aspect, the present invention provides a gene having a nucleotide sequence represented by any of SEQ ID NOs: 3, 7, 20, 21, 46, 47, 48, 49 and 50, a protein encoded by the gene or a fragment thereof. The gene preferably has a nucleotide sequence represented by any of SEQ ID NOs: 3, 7, 20, 21, 46, 49 and 50, more preferably has a nucleotide sequence represented by any of SEQ ID NOs: 3, 7, 20 and 21.

Such a protein or a fragment is useful as a composition for diagnosing or treating large bowel cancer.

In another aspect, the present invention provides a gene having a nucleotide sequence represented by any of SEQ ID NOs: 14, 15, 16, 17, 18, 19, 43, 44, 45, 56, 57, 58, 59, 62, 63, 64 and 65, a protein encoded by the gene or a fragment thereof. The gene preferably has a nucleotide sequence represented by any of SEQ ID NOs: 14, 15, 16, 17, 18, 19, 45, 56, 57, 58, 64 and 65, more preferably has a nucleotide sequence represented by any of SEQ ID NOs: 14, 15, 16, 17, 18, 19, 64 and 65.

Such a protein or a fragment is useful as a composition for diagnosing or treating liver cancer.

In a composition of the present invention, the gene preferably has a nucleotide sequence represented by any of SEQ ID NOs: 1, 9, 10, 14, 20, 22, 24, 25, 26, 27, 28, 29, 32, 38, 39, 40, 44, 51, 52, 53, 54 and 58, more preferably has a nucleotide sequence represented by any of SEQ ID NOs: 1, 9, 10, 14, 20, 22, 24, 25 and 26.

In addition, in a composition of the present invention, the gene preferably has a nucleotide sequence represented by any of SEQ ID NOs: 2, 3, 4, 5, 6, 7, 8, 11, 12, 13, 15, 16, 17, 18, 19, 21, 23, 30, 31, 33, 34, 35, 36, 37, 41, 42, 43, 45, 46, 47, 48, 49, 50, 55, 56, 57, 59, 60, 61, 62 and 63, more preferably has a nucleotide sequence represented by any of SEQ ID NOs: 2, 3, 4, 5, 6, 7, 8, 11, 12, 13, 15, 16, 17, 18, 19, 21 and 23.

In another aspect, the present invention provides a cell or a vector that expresses the above-mentioned gene or a fragment thereof. Such a cell or a vector is useful for producing a protein of the present invention, producing an antibody against the protein, as well as diagnosing or treating cancer and the like.

Instill another aspect, the present invention provides a protein having an amino acid sequence represented by any of SEQ ID NOs: 66 to 123 or a fragment thereof. Such a protein or a fragment thereof is useful as an antigen for producing an antibody or is useful for diagnosing or treating cancer.

In still another aspect, the present invention provides an antibody recognizing the above-mentioned protein or a fragment thereof or an antigen-binding fragment thereof. The present invention also provides a cell producing such an antibody.

In still another aspect, the present invention provides a polynucleotide having a nucleotide sequence represented by any of SEQ ID NOs: 1 to 65 or a nucleotide sequence complementary thereto, and a polynucleotide that can hybridize under high stringent conditions to any of these polynucleotides.

Further, the present invention provides a polynucleotide having a sequence comprising at least 12 consecutive nucleotides of a nucleotide sequence represented by any of SEQ ID NOs: 1 to 65 or a nucleotide sequence complementary thereto, and an oligonucleotide with a length of at least 12 nucleotides that can hybridize under high stringent conditions to a polynucleotide having a nucleotide sequence represented by any of SEQ ID NOs: 1 to 65.

Such a polynucleotide is useful for diagnosis of cancer, production of a protein, and as a primer, an antisense and siRNA for inhibiting gene expression.

In still another aspect, the present invention provides a method of identifying a compound having an anticancer activity comprising the steps of: bringing a cultured human cell into contact with a test compound; and identifying a compound that causes a change in the expression level of a gene containing a nucleotide sequence represented by any of SEQ ID NOs: 1 to 65 in the cell as a compound having an anticancer activity.

In still another aspect, the present invention provides a method of diagnosing cancer by detecting C20orf102 protein. It is preferred that the cancer is lung cancer, liver cancer or pancreatic cancer. In the method of the present invention, it is preferred that C20orf102 protein secreted outside a cell is detected. In addition, it is preferred that the method of the present invention is carried out by using an antibody recognizing C20orf02 protein. Preferably, in the method of the present invention, C20orf102 protein in blood, serum or plasma or C20orf102 protein secreted from a cell is detected.

In another aspect, the present invention provides a method of diagnosing cancer comprising the steps of:
(a) collecting a sample from a subject; and
(b) detecting C20orf102 protein contained in the collected sample.

BRIEF DESCRIPTION OF THE DRAWINGS

FIG. 67 shows the nucleotide sequence and the amino acid sequence of a novel gene K#1.

FIG. 68 shows the alignment of a novel gene K#1 with the gene of GenBank No. XM_067369.

FIG. 70 shows the nucleotide sequence and the amino acid sequence of a novel gene K#2 (clone 11).

FIG. 71 shows the nucleotide sequence and the amino acid sequence of a novel gene K#2 (clone 18).

FIG. 72 shows the comparison of the amino acid sequences of a novel gene K#2 (clone 11) with human LIN-28, *Caenorhabditis elegans* LIN-28, *Xenopus laevis* LIN-28, *Drosophila* LIN-28 and mouse LIN-28.

DETAILED DESCRIPTION OF THE INVENTION

Figure 1:
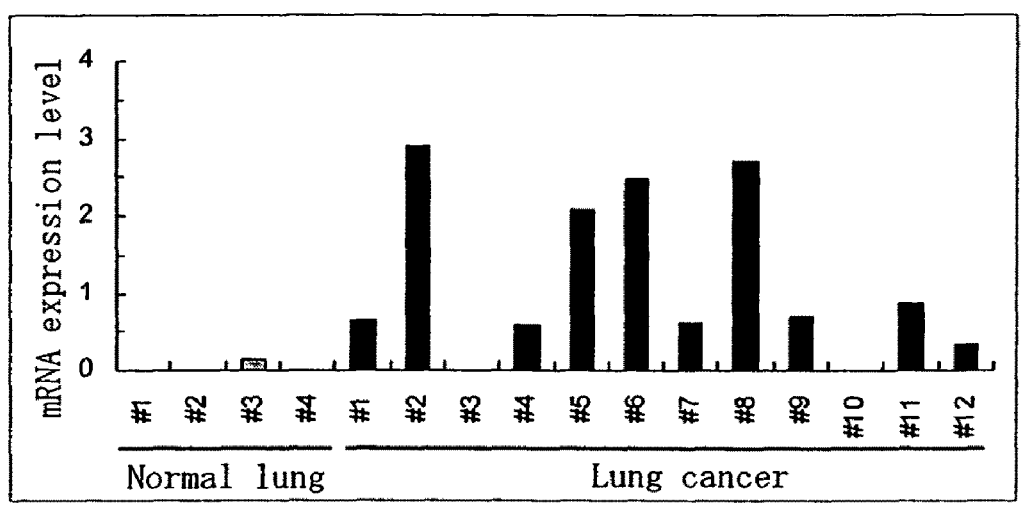
FIG. 1 shows the results of an expression analysis of a cancer-associated gene TEG1.

The present invention provides a composition for diagnosing and treating cancer utilizing a specific gene whose expression is elevated in a cancer tissue and a protein encoded by the gene.

Protein

In a first aspect, the present invention provides a protein encoded by a cancer-associated gene represented by any of SEQ ID NOs: 1 to 65 or a fragment thereof. Preferably, a composition of the present invention comprises a protein having an amino acid sequence represented by any of SEQ ID NOs: 66 to 123 or a fragment thereof.

The protein or the fragment thereof of the present invention is useful for diagnosing or treating cancer or as an antigen for producing an antibody.

In the composition of the present invention, the protein or the fragment thereof may be a variant in which one or more amino acid residues are substituted, added or deleted from the above-mentioned sequence, as long as it has a desired immunogenicity. It is preferred that such a variant has an amino acid sequence with an identity of at least 80%, preferably 90% or more, more preferably 95% or more with the above-mentioned amino acid sequence.

The identity of amino acid sequence is calculated by dividing the number of identical residues by the total number of residues in two sequences to be compared and multiplying by 100. Several computer programs for determining the identity of sequences using standard parameters are available, for example, Gapped BLAST or PSI-BLAST (Altschul, et al. (1997) *Nucleic Acids Res.* 25: 3389-3402), BLAST (Altschul, et al. (1990) *J. Mol. Biol.* 215: 403-410) and Smith-Waterman (Smith, et al. (1981) *J. Mol. Biol.* 147: 195-197).

It has been already known that a protein having an amino acid sequence which has been modified by deletion, addition and/or substitution with another amino acid of one or more amino acid residues in a certain amino acid sequence retains the original biological activity (Mark, D. F. et al., *Proc. Natl. Acad. Sci. USA* (1984) 81, 5662-5666, Zoller, M. J. & Smith, M. *Nucleic Acids Research* (1982) 10, 6487-6500, Wang, A. et al., *Science* 224, 1431-1433, Dalbadie-McFarland, G. et al., *Proc. Natl. Acad. Sci. USA* (1982) 79, 6409-6413).

It is preferred that an amino acid residue to be mutated is replaced with another amino acid residue in which the classes of the property of the amino acid side chain is conserved. Examples of the property of an amino acid side chain include a hydrophobic amino acid (A, I, L, M, F, P, W, Y, V), a hydrophilic amino acid (R, D, N, C, E, Q, G, H, K, S, T), an amino acid having an aliphatic side chain (G, A, V, L, I, P), an amino acid having a hydroxyl group-containing side chain (S, T, Y), an amino acid having a sulfur atom-containing side chain (C, M), an amino acid having a carboxylic acid and amide-containing side chain (D, N, E, Q), an amino acid having a base-containing side chain (R, K, H), and an amino acid having an aromatic containing side chain (H, F, Y, W). The parenthetic letters indicate the one-letter codes of amino acids.

A protein that is functionally equivalent to a given protein can be prepared by a method known to those skilled in the art, for example, by introducing an appropriate mutation into the amino acid using a site-directed mutagenesis method (Gotoh, T. et al. (1995), *Gene* 152, 271-275; Zoller, M J, and Smith, M. (1983), Methods Enzymol. 100, 468-500; Kramer, W. et al. (1984), *Nucleic Acids Res.* 12, 9441-9456, Kramer W, and Fritz H J (1987) *Methods. Enzymol.* 154, 350-367, Kunkel, T A (1985), *Proc. Natl. Acad. Sci. USA.* 82, 488-492, Kunkel (1988), *Methods Enzymol.* 85, 2763-2766).

The protein of the present invention can vary in its amino acid sequence, molecular weight, isoelectric point, and presence or absence of a sugar chain or the form of a sugar chain depending on a cell or a host used for producing the protein or a purification method as described later. For example, when the protein of the present invention is expressed in a prokaryotic cell such as *E. coli*, a methionine residue is added at the N-terminus of the amino acid sequence of the original protein. The protein of the present invention also includes such a protein.

The protein of the present invention can be prepared as a recombinant protein or as a naturally occurring protein by a method known to those skilled in the art. In the case of a recombinant protein, it can be prepared as follows. DNA encoding the protein of the present invention is introduced into an appropriate expression vector, and the vector is introduced into an appropriate host cell. Then, the resulting transformant is collected, and an extract is obtained. Then the protein is purified by chromatography such as ion exchange, reverse phase, or gel filtration chromatography, or by affinity chromatography with a column on which antibodies against the protein of the present invention are immobilized, or combination of one or more of these columns.

Further, when the protein of the present invention is expressed in a host cell (such as an animal cell or *E. coli*), as a fusion protein with glutathione S-transferase protein or as a recombinant protein supplemented with multiple histidine residues, the expressed recombinant protein can be purified using a glutathione column or a nickel column, respectively. After purifying the fusion protein, it is also possible to remove regions other than the intended protein from the fusion protein by cutting with thrombin, factor-Xa or the like as needed.

In the case of a natural protein, it can be isolated by a method well known to those skilled in the art, for example, by purifying an extract of tissue or cells expressing the protein of the present invention with an affinity column having antibodies that binds to the protein of the present invention, which will be described later. The antibody may be a polyclonal antibody or a monoclonal antibody.

The present invention also encompasses a fragment (partial peptide) of the protein of the present invention. The fragment of the present invention can be used in producing an antibody against the protein of the present invention, screening a compound binding to the protein of the present invention, or screening a stimulator or an inhibitor of the protein of the present invention. In addition, it can be used as an antagonist or a competitive inhibitor of the protein of the present invention.

When the fragment of the present invention is used as an immunogen, it is composed of at least 7 amino acids or more, preferably 8 amino acids or more, and more preferably 9 amino acids or more. When it is used as a competitive inhibitor of the protein of the present invention, it comprises an amino acid sequence of at least 100 amino acids or more, preferably 200 amino acids or more, more preferably 300 amino acids or more.

The fragment of the present invention can be produced by a genetic engineering technique, a well-known peptide synthesizing method, or by cleaving the protein of the present invention with a suitable peptidase. The peptide synthesis may be carried out by, for example, a solid phase synthesis method or a liquid phase synthesis method.

Moreover, the present invention provides a vector into which the DNA of the present invention is inserted. The vector of the present invention may be useful for maintaining the DNA of the present invention in a host cell or expressing the protein of the present invention.

When *E. coli* is used as a host, it is preferred that the vector has an "ori" to be amplified in *E. coli* and a gene for selecting the transformed *E. coli* (e.g., a drug resistance gene that can be selected by a drug such as ampicillin, tetracycline kanamycin, or chloramphenicol). in order to amplify and prepare the vector in a large amount in *E. coli* (such as JM109, DH5α, HB101 or XL1Blue).

Examples of the vector include M13-series vectors, pUC-series vectors, pBR322, pBluescript, pCR-Script and the like. In addition, when it is intended to be used for subcloning and excision of the cDNA, pGEM-T, pDIRECT, pT7 and the like may also be used in addition to the above-mentioned vectors.

When the vector is used to produce the protein of the present invention, an expression vector is especially useful. When the expression vector is intended to be expressed in *E. coli*, the vector should have the above-mentioned characteristic for amplification of the vector in *E. coli*. Additionally, when *E. coli* such as JM109, DH5α, HB101 or XL1-Blue is used as a host cell, it is essential that the vector should have a promoter that can efficiently drive the expression in *E. coli*, for example, lacZ promoter (Ward et al., Nature (1989) 341: 544-546; FASEB J. (1992) 6: 2422-2427), araB promoter (Better et al., Science (1988) 240: 1041-1043), or T7 promoter, Examples of such a vector include other than the above-mentioned vectors, pGEX-5X-1 (manufactured by Pharmacia), "QIAexpress system" (manufactured by QIAGEN), pEGFP, pET (for this vector, BL21 expressing T7 RNA polymerase is preferably used as a host) and the like.

Further, the vector may contain a signal sequence for protein secretion. When the protein is secreted into the periplasm of *E. coli*, pelB signal sequence (Lei S. P. et al., *J. Bacteriol.* (1987) 169, 4379) may be used as a signal sequence for protein secretion. The introduction of the vector into a host cell can be carried out by, for example, a calcium chloride method or an electroporation method.

Examples of the vector used to produce the protein of the present invention include expression vectors other than those from *E. coli*, for example, expression vectors derived from mammals (e.g., pcDNA3 (manufactured by Invitrogen), pEGF-BOS (Nucleic Acids. Res. 1990, 18 (17), p 5322), pEF, and pCDM8); expression vectors derived from insect cells (e.g., "Bac-to-BAC baculovirus expression system" (manufactured by GIBCO BRL), pBacPAK8); expression vectors derived from plants (e.g., pMH1 and pMH2); expression vectors derived from animal viruses (e.g., pHSV, pMV, and pAdexLcw); expression vectors derived from retroviruses (e.g., pZIPneo); expression vectors derived from yeast (e.g., "*Pichia* Expression Kit" (manufactured by Invitrogen), pNV11 and SP-Q01); and expression vectors derived from *Bacillus subtilis* (e.g., pPL608 and pKTH50).

When it is intended to express the protein in an animal cell, such as a CHO cell, COS cell, or NIH3T3 cell, it is essential that the vector should include a promoter necessary for expression in such a cell, for example, SV40 promoter (Mulligan et al., Nature (1979) 277, 108), MMLV-LTR promoter, the EF1α promoter (Mizushima et al., Nucleic Acids Res. (1990) 18, 5322), and CMV promoter. It is more preferred that the vector additionally has a gene for selecting the transformed cell (e.g., a drug resistance gene that allows for selection with a drug such as neomycin or G418). Examples of the vector having such a characteristic include pMAM, pDR2, pBK-RSV, pBK-CMV, pOPRSV, pOP13 and the like.

Further, when it is intended to stably express the gene and to amplify the copy number of genes in a cell, a vector (such as pCHOI) having a DHFR gene that compensates for the deficiency may be introduced into a CHO cell deficient in nucleic acid synthetic pathways, and amplified with methotrexate (MTX). Further, when it is intended to transiently express the gene, a COS cell having a gene expressing SV40 T antigen on the chromosome may be transformed with a vector (such as pCD) having SV40 replication origin. The replication origin may include those derived from polyoma virus, adenovirus, bovine papillomavirus (BPV) and the like. Further, in order to amplify the gene copy number in a host cell system, the expression vector can include as a selection marker, the aminoglycoside transferase (APH) gene, the thymidine kinase (TK) gene, the *E. coli* xanthine guanine phosphoribosyl transferase (Ecogpt) gene, the dihydrofolate reductase (dhfr) gene or the like.

Further, the present invention provides a host cell into which the vector of the present invention is introduced. The host cell is not particularly limited but may include, for example, *E. coli*, various animal cells and the like. The host cell of the present invention may be used, for example, as a production system for producing and expressing the protein of the present invention. There are in vitro and in vivo production systems available for producing the protein. Examples of the in vitro production system include a production system using a eukaryotic cell and a production system using a prokaryotic cell.

When the eukaryotic cell is used, for example, an animal cell, a plant cell or a fungal cell can be used as a host. The animal cells known in the art include mammalian cells, such as CHO (J. Exp. Med. (1995) 108, 945), COS, 3T3, myeloma, baby hamster kidney (BHK), HeLa and Vero; amphibian cells such as *Xenopus laevis* oocytes (Valle, et al., Nature (1981) 291, 338-340); and insect cells such as sf9, sf21 and Tn5. CHO cells preferably used in the invention include those deficient in the DHFR gene such as dhfr-CHO (Proc. Natl. Acad. Sci. USA (1980) 77, 4216-4220) and CHO K-1 (Proc. Natl. Acad. Sci. USA (1968) 60, 1275). Among the animal cells, the CHO cell is particularly preferred for mass expression. Introduction of the vector into the host cell can be carried out by, for example, a calcium phosphate method, a DEAE-dextran method, a method using cationic liposome DOTAP (manufactured by Boehringer Mannheim), an electroporation method, lipofection or the like.

A plant cell derived from *Nicotiana tabacum* is known as a protein production system and may be subjected to callus culture. Fungal cells known in the art include yeast such as the *Saccharomyces* genus, for example, *Saccharomyces cerevisiae* and filamentous bacteria such as *Aspergillus* genus, for example, *Aspergillus niger*.

For prokaryotic cells, various production systems utilizing a bacterial cell are available. Examples of the bacterial cell include *E. coli* such as JM109, DH5α and HB101, and the like. In addition, *Bacillus subtilis* is also available.

Such a cell is transformed by a desired DNA, and the resulting transformed cell is cultured in vitro to obtain the protein. Cultivation can be carried out according to a known method. The culture medium used for animal cells include, for example, DMEM, MEM, RPMI1640, or IMDM. A serum supplement such as fetal calf serum (FCS) may be used in combination with the medium, or serum free culture may be carried out. The pH of the culture medium during the cultivation ranges preferably from about 6 to 8. Cultivation is generally carried out at about 30 to 40° C., for 15 to 200 hours, and the culture medium may be replaced, aerated, or stirred as needed.

On the other hand, examples of the in vivo protein production system include a production system using an animal and a production system using a plant. A desired DNA is introduced into such an animal or a plant, and the protein is allowed to be produced in the animal or the plant, and then collected. The term "host" in the present invention encompasses such an animal and a plant.

For animals, various production systems utilizing a mammal or an insect are available. The mammal includes goats, pigs, sheep, mice and cattle (Vicki Glaser, SPECTRUM Biotechnology Applications, 1993). In addition, the mammal may also include a transgenic animal.

For example, a desired DNA is prepared as a fusion gene with a gene encoding a protein such as goat β-casein that is specifically produced into milk. Next, the DNA fragment containing this fusion gene is injected into a goat's embryo, which is then implanted in a female goat. A desired protein can be obtained from milk produced by a transgenic goat which is born from the goat that had received the embryo or offspring thereof. To increase the amount of milk containing the protein produced by the transgenic goat, an appropriate hormone may be administered to the transgenic goat (Ebert, K. M. et al., Bio/Technology (1994) 12, 699-702).

Further, a silkworm may be used as a host insect. The silkworm is infected with a baculovirus into which DNA encoding a desired protein has been inserted. The desired protein can be obtained from the body fluid of the silkworm (Susumu, M. et al., Nature (1985) 315, 592-594).

Further, tobacco may be used as a plant host. DNA encoding a desired protein is inserted into a plant expression vector such as pMON 530, and this vector is introduced into bacteria such as *Agrobacterium tumefaciens*. Then, tobacco such as *Nicotiana tabacum* is infected with the bacteria and the desired protein can be obtained from the leaves of the tobacco (Julian, K.-C. Ma et al., Eur. J. Immunol. (1994) 24, 131-138).

The protein of the present invention obtained as above can be isolated from the inside or the outside of the host cell (such as medium) and purified to a substantially pure homogenous protein. Any method commonly used for isolation and purification of protein may be used for purifying the protein. For example, chromatography column, filtration, ultrafiltration, salting out, solvent precipitation, solvent extraction, distillation, immunoprecipitation, SDS-polyacrylamide gel electrophoresis, isoelectric focusing, dialysis, recrystallization and the like may be suitably selected and combined, whereby the protein can be isolated and purified.

Examples of the chromatography include affinity chromatography, ion exchange chromatography, hydrophobic chromatography, gel filtration, reversed-phase chromatography, adsorption chromatography and the like (Strategies for Protein Purification and Characterization: A Laboratory Course Manual. Ed Daniel R. Marshak et al., *Cold Spring Harbor Laboratory Press*, 1996). Such chromatography can be carried out by liquid chromatography such as HPLC or FPLC. A protein highly purified by using such a purification method is also encompassed by the present invention.

The protein can be optionally modified or a peptide portion can be removed by treating the protein with an appropriate protein-modifying enzyme before or after the purification of the protein. Such a protein-modifying enzyme includes, for example, trypsin, chymotrypsin, lysylendopeptidase, protein kinase, glucosidase and the like.

As shown in Examples described below, PCR primers were designed based on the gene sequences of cancer-associated genes represented by SEQ ID NOs: 1 to 65 (see Table 1) and the expression level of the cancer-associated genes in human tissue was quantified by quantitative PCR using cDNA obtained from human normal tissue and cancer tissue. It was found that the expression of the cancer-associated genes of the present invention is elevated in certain human cancer tissue.

The expression of a gene having a nucleotide sequence represented by any of SEQ ID NOs: 1, 2, 28, 29, 30, 31, 32, 51, 52, 60 and 61 was found to be elevated in lung cancer. Thus, a protein encoded by the gene having a nucleotide sequence represented by any of SEQ ID NOs: 1, 2, 28, 29, 30, 31, 32, 51, 52, 60 and 61 or a fragment thereof is useful for diagnosing or treating lung cancer. The gene preferably has a nucleotide sequence represented by any of SEQ ID NOs: 1, 2, 28, 29, 30, 31 and 32, more preferably has a nucleotide sequence represented by SEQ ID NO: 1 or 2.

The expression of a gene having a nucleotide sequence represented by any of SEQ ID NOs: 3, 4, 5, 6, 7, 8, 9, 10, 11, 12, 13, 22, 23, 24, 25, 26, 27, 33, 34, 35, 36, 37, 38, 39, 40, 41, 42, 53, 54 and 55 was found to be elevated in stomach cancer. Thus, a protein encoded by the gene having a nucleotide sequence represented by any of SEQ ID NOs: 3, 4, 5, 6, 7, 8, 9, 10, 11, 12, 13, 22, 23, 24, 25, 26, 27, 33, 34, 35, 36, 37, 38, 39, 40, 41, 42, 53, 54 and 55 or a fragment thereof is useful for diagnosing or treating stomach cancer. The gene preferably has a nucleotide sequence represented by any of SEQ ID NOs: 3, 4, 5, 6, 7, 8, 9, 10, 11, 12, 13, 22, 23, 24, 25 and 26.

The expression of a gene having a nucleotide sequence represented by any of SEQ ID NOs: 3, 7, 20, 21, 46, 47, 48, 49 and 50 was found to be elevated in large bowel cancer. Thus, a protein encoded by the gene having a nucleotide sequence represented by any of SEQ ID NOs: 3, 7, 20, 21, 46, 47, 48, 49 and 50 or a fragment thereof is useful for diagnosing or treating large bowel cancer. The gene preferably has a nucleotide sequence represented by any of SEQ ID NOs: 3, 7, 20, 21, 46, 49 and 50, more preferably has a nucleotide sequence represented by any of SEQ ID NOs: 3, 7, 20 and 21.

The expression of a gene having a nucleotide sequence represented by any of SEQ ID NOs: 14, 15, 16, 17, 18, 19, 43, 44, 45, 56, 57, 58, 59, 62, 63, 64 and 65 was found to be elevated in liver cancer. Thus, a protein encoded by the gene having a nucleotide sequence represented by any of SEQ ID NOs: 14, 15, 16, 17, 18, 19, 43, 44, 45, 56, 57, 58, 59, 62, 63, 64 and 65 or a fragment thereof is useful for diagnosing or treating liver cancer. The gene preferably has a nucleotide sequence represented by any of SEQ ID NOs: 14, 15, 16, 17, 18, 19, 45, 56, 57, 58, 64 and 65, more preferably has a nucleotide sequence represented by any of SEQ ID NOs: 14, 15, 16, 17, 18, 19, 64 and 65.

The composition of the present invention comprising a protein encoded by a cancer-associated gene represented by any of SEQ ID NOs: 1 to 65 or a fragment thereof can be used as a vaccine against cancer. By administering to a targeted human or another animal the above-mentioned protein or an immunogenic fragment thereof together with an appropriate adjuvant, or as a fusion protein with another suitable polypeptide, immune response will be induced in the body of the human or the animal. Alternatively, the composition of the present invention may be administered in the form of a cell expressing the above-mentioned cancer-associated gene or fragment thereof.

Further, the composition of the present invention can be used to diagnose whether a subject is affected with a specific cancer by determining whether the subject has an antibody against a protein encoded by a cancer-associated gene represented by any of SEQ ID NOs: 1 to 65.

Antibody

In another aspect, the present invention provides an antibody recognizing a protein encoded by a cancer-associated gene having a nucleotide sequence represented by SEQ ID NOs: 1 to 65 or a fragment of the protein, or an antigen-binding fragment of the antibody. Further, the present invention provides a composition for diagnosing or treating cancer comprising the antibody or the binding fragment thereof. The antibody of the present invention can preferably recognize a protein having an amino acid sequence represented by SEQ ID NOs: 66 to 123 or a fragment thereof. The present invention also provides a cell producing such an antibody.

The term "recognize" means that an antibody binds to the above-mentioned protein encoded by a cancer-associated gene or a fragment thereof under specific conditions with higher affinity than it binds to another polypeptide.

The antibody of the present invention may include monoclonal antibodies, polyclonal antibodies, antibodies having an ability of specifically binding to an antigen determinant, variants and derivatives of antibodies such as T-cell receptor fragments.

The type of the antibody of the present invention is not particularly limited, but may include a mouse antibody, a human antibody, a rat antibody a rabbit antibody, a sheep antibody, a camel antibody or the like. Also included are a genetically recombinant antibody which has been artificially modified for the purpose of lowering heterologous antigenicity against human such as a chimeric antibody, a humanized antibody or the like. The genetically recombinant antibody can be produced by a known method. The chimeric antibody is an antibody comprising antibody heavy chain and light chain variable regions of a non-human mammal such as a mouse, and the antibody heavy chain and light chain constant regions of a human. It can be obtained by ligating DNA encoding the variable region of a mouse antibody to DNA encoding the constant region of a human antibody, which is then introduced into an expression vector and introduced into a host for production of the antibody. A humanized antibody, also referred to as a reshaped human antibody, is obtained by transplanting a complementarity determining region (CDR) of an antibody of a non-human mammal such as a mouse, into the complementarity determining region of a human antibody. A general technique of genetic recombination is also known. Specifically, a DNA sequence designed to ligate a CDR of a mouse antibody to the framework region (FR) of a human antibody is synthesized by a PCR method using several oligonucleotides constructed to have overlapping portions at their ends. Then, the resulting DNA is ligated to DNA encoding a human antibody constant region, which is introduced into an expression vector, and the vector is introduced into a host to produce an antibody, whereby a humanized antibody can be obtained (see European Patent Application No. EP239400, and International Patent Application No. WO 96/02576). The human antibody FR that is ligated via the CDR is selected to allow the complementarity determining region to form a favorable antigen-binding site. As necessary, an amino acid in the framework region of an antibody variable region may be substituted such that the complementarity determining region of a reshaped human antibody forms an appropriate antigen-binding site (Sato, K. et al., Cancer Res. 1993, 53, 851-856).

Methods for obtaining a human antibody are also known. For example, a desired human antibody having an antigen-binding activity can be obtained by sensitizing a human lymphocyte with a desired antigen or a cell expressing a desired antigen in vitro, and fusing the sensitized lymphocyte with a human myeloma cell such as U266 (see JP-B-1-59878). Alternatively, a desired human antibody can also be obtained by using a desired antigen to immunize a transgenic animal having the entire repertoire of human antibody genes (see International Patent Application Nos. WO 93/12227, WO 92/03918, WO 94/02602, WO 94/25585, WO 96/34096 and WO 96/33735). Further, techniques to obtain a human antibody by panning with a human antibody library are known in the art. For example, the variable region of a human antibody is expressed as a single chain antibody (scFv) on the surface of a phage using a phage display method, and a phage binding to the antigen can be selected. By analyzing the gene of the selected phage, the DNA sequence encoding the variable region of a human antibody binding to the antigen can be determined. If the DNA sequence of scFv that binds to the antigen is identified, an appropriate expression vector containing the sequence is constructed, and a human antibody can be obtained. These methods are already well known and described in WO 92/01047, WO 92/20791, WO 93/06213, WO 93/11236, WO 93/19172, WO 95/01438 and WO 95/15388.

Moreover, the antibody of the invention may also be a low molecular weight antibody such as an antibody fragment or a modified antibody as long as it can bind to an antigen. Specific examples of the antibody fragment include Fab, Fab', F(ab')$_2$, Fv, Diabody and the like. To obtain such an antibody fragment, a gene encoding such an antibody fragment is constructed, the gene is introduced into an expression vector, and then the gene may be expressed in a suitable host cell (see, for example, Co, M. S. et al., J. Immunol. (1994) 152, 2968-2976; Better, M. and Horwitz, A. H., Methods Enzymol. (1989) 178, 476-496; Pluckthun, A. and Skerra, A., Methods Enzymol. (1989) 178, 497-515; Lamoyi, E., Methods Enzymol. (1986) 121, 652-663; Rousseaux, J. et al., Methods Enzymol. (1986) 121, 663-669; and Bird, R. E. and Walker, B. W., Trends Biotechnol. (1991) 9, 132-137).

The modified antibody may also include an antibody bound to any of a variety of molecules such as polyethylene glycol (PEG). In addition, a radioisotope, a chemotherapeutic agent, a cytotoxic substance such as a bacteria-derived toxin may be attached to the antibody. A radiolabeled antibody is particularly useful. Such a modified antibody can be obtained by subjecting the obtained antibody to chemical modification. The method of modifying an antibody has been already established in this field.

Further, it is possible to use an antibody Whose sugar chain is modified for the purpose of enhancing the cytotoxic activity or the like. Techniques to modify a sugar chain of an antibody have been already known (e.g., WO 00/61739, WO 02/31140, etc.)

Further, the present invention also encompasses a multi-specific antibody having specificity for at least two different antigens. While such a molecule is generally binds to two antigens (i.e., bispecific antibody), the term "multispecific antibody" in the present invention encompasses an antibody having specificity for two or more (such as three) antigens. The multispecific antibody can be a full length antibody or a fragment of such an antibody (e.g. F(ab')$_2$ bispecific antibody).

Methods for producing the multispecific antibody are known in the art. Production of a full length bispecific antibody comprises co-expression of two immunoglobulin heavy chain-light chain pairs in which the two chains have different specificities (Millstein et al., Nature, 305: 537-539 (1983)). Because of the random assortment of immunoglobulin heavy chain and light chain, plural hybridomas (quadromas) co-expressing the heavy and light chains are obtained as a mixture of hybridomas respectively expressing different antibody molecules. Thus, it is necessary to select those producing a correct bispecific antibody. The selection can be carried out by affinity chromatography. In another method, antibody variable domains with the desired binding specificities are fused to immunoglobulin constant domain sequences. The constant domain sequence preferably comprises at least part of the hinge, CH2, and CH3 regions of the immunoglobulin heavy chain constant domain. It is preferred to contain the heavy chain CH1 region necessary for binding with the light chain. DNA encoding the immunoglobulin heavy chain fusions and, if desired, DNA encoding the immunoglobulin light chains, are inserted into separate expression vectors, and are transfected into a suitable host organism. Insertion of the respective genes into separate expression vectors will allow for adjustment of the expression ratios of the respective chains. This method is convenient when unequal ratios of the respective chains will provide an increase in the yield of the obtained antibody. It is, however, possible to insert the genes encoding plural chains into one vector.

In a preferred embodiment, a bispecific antibody is composed of a hybrid immunoglobulin heavy chain with a first binding specificity in one arm, and a hybrid immunoglobulin heavy chain-light chain pair with a second binding specificity in the other arm. By allowing an immunoglobulin light chain to be present in only one arm in this way, the isolation of the bispecific antibody from other immunoglobulins can be readily carried out. As for the isolation method, see WO 94/04690. As for the production method of the bispecific antibody, see the method of Suresh et al. (*Methods in Enzymology*, 121: 210 (1986)) To decrease the number of homodimers in the final product obtained from the recombinant cell culture and increase the ratio of the heterodimers, one antibody molecule including CH3 of an antibody constant domain may be modified, where one or more amino acids with a small side chain present on the surface and binding to the other molecule are replaced with an amino acid with a larger side chain (e.g. tyrosine or tryptophan), and an amino acid with a large side chain in the region corresponding to the other antibody molecule is replaced with a smaller one (e.g. alanine or threonine), whereby a cavity corresponding to the larger side chain in the first antibody molecule is created (WO 96/27011).

The bispecific antibody also include a heteroconjugate antibody in which one antibody is coupled to avidin and the other is coupled to biotin or the like (U.S. Pat. No. 4,676,980, WO 91/00360, WO 92/200373, and EP 03089). A cross-linking agent to be used in the production of such a heteroconjugate antibody is well known, and is disclosed in, for instance, U.S. Pat. No. 4,676,980.

A method for producing the bispecific antibody from an antibody fragment has also been reported. For example, it can be produced by utilizing a chemical bond. First, $F(ab')_2$ fragments are produced and are reduced in the presence of sodium arsenite, a dithiol complexing agent, in order to prevent disulfide formation within the same molecule. Then, the $F(ab')_2$ fragments are converted to thionitrobenzoate (TNB) derivatives. Then, one of the $F(ab')_2$-TNB derivatives is reduced again to the Fab'-thiol with mercaptoethylamine, and the $F(ab')_2$-TNB derivatives are mixed with an equimolar amount of the Fab'-thiol, whereby a bispecific antibody is produced.

Various methods for producing and isolating bispecific antibodies directly from the recombinant cell culture have also been reported. For example, a method for producing bispecific antibodies using leucine zippers has been reported (Kostelny et al., *J. Immunol.*, 148 (5): 1547-1553 (1992)). First, the leucine zipper peptides from the Fos and Jun proteins were linked to the Fab' portions of different antibodies by gene fusion. The antibody homodimers were reduced at the hinge region to form monomers and then re-oxidized to form antibody heterodimers. Another method is available in which a heavy-chain variable domain (VH) is connected to a light-chain variable domain (VL) via a linker which is too short to allow pairing between these two domains to form a pair of complementary other VL and VH domains, whereby two antigen-binding sites are created (Hollinger et al., *Proc. Natl. Acad. Sci. USA* 90: 6444-6448 (1993)). In addition, dimers obtained from a single-chain Fv (sFv) have also been reported (Gruger et al., *J. Immunol.*, 152: 5368 (1994)). Further, trispecific antibodies instead of bispecific antibodies have also been reported (Tutt et al. *J. Immunol.* 147: 60 (1991)).

The "antibody" in the present invention also encompasses antibodies described above.

The antibody and the antibody fragment of the present invention can be produced by any suitable manner such as in vivo, cultured cells, in vitro translation reaction or a recombinant DNA expression system.

Techniques for producing monoclonal antibodies and hybridomas are well known in the art. (Campbell, "Monoclonal Antibody Technology: Laboratory Techniques in Biochemistry and Molecular Biology", Elsevier Science Publishers, Amsterdam, The Netherlands, 1984; St. Groth, et al., *J. Immunol. Methods* 35: 1-21, 1980). The above-mentioned protein encoded by a cancer-associated gene or a fragment thereof may be used as an antigen to immunize any animal (mouse, rabbit, or the like) which is known to produce antibodies by subcutaneous or intraperitoneal injection. An adjuvant may be used in the immunization, and the use of such an adjuvant is well known in the art.

Polyclonal antibodies can be obtained by isolating antisera containing antibodies from an immunized animal, and detecting the presence of an antibody with the desired specificity by using a well known method in the art such as an ELISA assay, Western blot analysis, or radioimmunoassay.

Monoclonal antibodies can be obtained by excising spleen cells from an immunized animal, fusing the spleen cells with myeloma cells, and producing hybridoma cells that produces monoclonal antibodies. A hybridoma cell that produces an antibody recognizing a desired protein or a fragment thereof is selected using a method well known in the art such as an ELISA assay, Western blot analysis, or radioimmunoassay. A hybridoma secreting the desired antibody is cloned and cultured under appropriate conditions, the secreted antibody is recovered, and purified by a method well known in the art, such as ion exchange column or affinity chromatography. Alternatively, a human monoclonal antibody may be produced by using a XenoMouse strain (see Green *J. Immunol. Methods* 231: 11-23, 1999; Wells, Eek, *Chem Biol* 2000 August; 7 (8): R185-6).

The DNA encoding the monoclonal antibody can be readily isolated and sequenced using a conventional method (e.g., by using an oligonucleotide probe capable of binding specifically to genes encoding the heavy chain and the light chain of the monoclonal antibody). The hybridoma cells serve as a preferred source of such DNA. Once isolated, the DNA is inserted into an expression vector, which is then transfected into a host cell such as an *E. coli* cell, simian COS cell, Chinese Hamster Ovary (CHO) cell, or myeloma cell that does not otherwise produce immunoglobulin protein, whereby a monoclonal antibody is produced in the recombinant host cell. In another embodiment, an antibody or antibody fragment can be isolated from an antibody phage library generated using the techniques described in McCafferty et al. (*Nature* 348: 552-554 (1990)).

The above-mentioned antibody can be detectably labeled. Examples of the label include radioisotopes, affinity labels (such as biotin and avidin), enzymatic labels (such as horseradish peroxidase and alkaline phosphatase), fluorescent labels (such as FITC or rhodamine), paramagnetic atoms and the like. Methods for accomplishing such labeling are well known in the art. The above-mentioned antibodies may be immobilized on a solid support. Examples of the solid support include plastic, agarose, sepharose, polyacrylamide, latex beads and the like. Techniques for immobilizing antibodies on such a solid support are well known in the art.

As described in Examples below, the cancer-associated gene of the present invention shows elevated expression in a specific cancer tissue, therefore the antibody of the present invention is useful as a diagnostic marker for cancer. The expression of the protein encoded by a cancer-associated gene can be detected in a tissue or cell using the antibody of the present invention in a method such as Western blotting, the ELISA method or histological staining. A sample (such as biopsy sample or blood sample) derived from tissue of a subject is brought into contact with the composition of the present invention under conditions so as to form an immune complex. The presence or the amount of the protein encoded by a cancer-associated gene in the sample can be determined by determining whether the sample binds to the antibody. In this way, diagnosis of cancer, monitoring of progress or cure of cancer, and prediction of prognosis may be carried out. The diagnostic composition of the present invention may be provided as a kit for detecting the presence of the above-mentioned protein encoded by a cancer-associated gene in a sample. Such a kit may contain, in addition to the above-mentioned antibody, a washing reagent, a reagent that can detect the presence of the bound antibody such as a labeled secondary antibody, a chromophore that can react with the labeled antibody, an enzyme, and an antibody-binding reagent, and a usage guideline.

Further, the antibody against the protein encoded by the cancer-associated gene of the present invention has some specificity for a specific cancer cell, therefore it may be used as a therapeutic agent for cancer or may be used in a missile therapy, where a drug is allowed to specifically target cancer tissue. Preferably, the composition of the present invention is used in diagnosis and treatment of lung cancer, stomach cancer, large bowel cancer and liver cancer.

The therapeutic agent of the present invention may be formulated with a pharmaceutically acceptable carrier well known in the art by mixing, dissolving, granulating, tableting, emulsifying, encapsulating, lyophilizing or other processes.

For oral administration, the therapeutic agent of the present invention can be formulated with a pharmaceutically acceptable solvent, excipient, binder, stabilizer, dispersant or the like, into the dosage form such as a tablet, a pill, a sugarcoated pill, a soft capsule, a hard capsule, a solution, a suspension, an emulsion, a gel, a syrup or a slurry.

For parenteral administration, the therapeutic agent of the present invention can be formulated with a pharmaceutically acceptable solvent, excipient, binder, stabilizer, dispersant or the like, into the dosage form such as an injectable solution, a suspension, an emulsion, a cream, an ointment, an inhalant or a suppository. For injectable formulation, the therapeutic agent of the present invention can be dissolved in an aqueous solution, preferably in a physiologically compatible buffer such as Hanks, solution, Ringer's solution or a physiological saline buffer. Further, the composition can take the form of a suspension, a solution, an emulsion or the like in an oleaginous or aqueous vehicle. Alternatively, the therapeutic agent may be produced in the form of powder, and an aqueous solution or a suspension may be prepared with sterilized water or the like before use. For administration by inhalation, the therapeutic agent of the present invention is powdered and formulated into a powder mixture with a suitable base such as lactose or starch. The suppository formulation can be produced by mixing the therapeutic agent of the present invention with a conventional suppository base such as cocoa butter. Further, the therapeutic agent of the present invention can be formulated as a sustained-release preparation by encapsulating it into a polymer matrix or the like.

The dose and the dose frequency may vary depending on the dosage form, the administration route and the patient's symptoms, age and body weight, however, the therapeutic agent of the present invention can generally be administered at a dose of about 0.001 mg to 1000 mg, preferably about 0.01 mg to 10 mg per kg of body weight per day, which can be taken once to several times a day.

In general, the therapeutic agent is parenterally administered, for example, by injection (subcutaneous, intravenous, intramuscular, intraperitoneal injection or the like), or by transdermal, transmucosal, transnasal, transpulmonary administration or the like, however, the administration route is not particularly limited, and it may be orally administered.

Polynucleotide

In still another aspect, the present invention provides a polynucleotide having a nucleotide sequence represented by any of SEQ ID NOs: 1 to 65 or a nucleotide sequence complementary thereto or a polynucleotide that can hybridize under high stringent conditions to any of these polynucleotides.

Further, the present invention provides a composition containing a polynucleotide having a sequence comprising at least 12 consecutive nucleotides of a nucleotide sequence represented by any of SEQ ID NOs: 1 to 65 or a nucleotide sequence complementary thereto or an oligonucleotide with a length of at least 12 nucleotides that can hybridize under high stringent conditions to a polynucleotide having a nucleotide sequence represented by any of SEQ ID NOs: 1 to 65.

Such a polynucleotide is useful for diagnosis of cancer, production of a protein, a primer, an antisense or siRNA for inhibiting gene expression and the like. The cancer is preferably selected from lung cancer, stomach cancer, large bowel cancer and liver cancer.

The expression of the cancer-associated genes of the present invention represented by SEQ ID NOs: 1 to 65 is elevated in a specific human cancer tissue as shown in the following Examples. Therefore, the composition of the present invention may be used as an agent of antisense oligonucleotide, ribozyme, siRNA or the like for silencing the expression of the cancer-associated gene, and as a probe or a primer for detecting the cancer-associated gene. It can also be used for producing the protein of the present invention.

The polynucleotide or the oligonucleotide contained in the composition of the present invention may be single stranded or double stranded, and may be DNA, RNA, or a mixture thereof or a derivative of PNA or the like. Such a polynucleotide or oligonucleotide may be chemically modified at the internucleoside linkage, the base moiety and/or the sugar moiety, or may have a modifier at the 5' end and/or 3' end. Examples of the modified internucleoside linkage include phosphorothioate, phosphorodithioate, phosphoramidothioate, phosphoramidate, phosphorodiamidate, methylphosphonate, alkylphosphotriester, formacetyl and the like. Examples of the modified base moiety include 5-fluorouracil, 5-bromouracil, 5-chlorouracil, 5-iodouracil, hypoxanthine, xanthine, 4-acetylcytosine, 5-(carboxyhydroxyethyl) uracil and the like. Examples of the modified sugar moiety include 2'-O-alkyl, 2'-O-alkyl-O-alkyl or 2'-fluoro modification and the like. In addition, a sugar other than ribose may also be used, for example, arabinose, 2-fluoroarabinose, xylulose and hexose.

The polynucleotide of the present invention includes a polynucleotide having a nucleotide sequence represented by any of SEQ ID NOs: 1 to 65 or a nucleotide sequence complementary thereto or a polynucleotide that can hybridize under high stringent conditions to any of these polynucleotides. A polynucleotide that can hybridize under stringent conditions generally has a high identity. The term "high identity" as used herein means that it has an identity of 70% or more, preferably 80% or more, more preferably 90% or more with a nucleotide sequence represented by any of SEQ ID NOs: 1 to 65.

The identity of a nucleotide sequence can be determined by using the algorithm BLAST by Karlin and Altschul (*Proc. Natl. Acad. Sci. USA*, 90: 5873-5877, 1993). The programs called BLASTN and BLASTX have been developed based on the above algorithm (Altschul et al., *J. Mol. Biol.*, 215: 403-410 1990). In the case of analyzing a nucleotide sequence by BLASTN based on BLAST, the parameters can be set, for example, score=100 and wordlength=12. BLAST and Gapped BLAST programs may be used with its default parameter. The specific techniques of these analysis methods are known in the art (http://www.ncbi.nlm.nih.gov.).

Further, the present invention encompasses a polynucleotide encoding an amino acid sequence represented by any of SEQ ID NOs: 66 to 123. Such a polynucleotide may be used in the production of the protein of the present invention. In addition, since a polynucleotide having a nucleotide sequence represented by any of SEQ ID NOs: 1 to 65 or a sequence complementary thereto is overexpressed in a cancer cell, it can be used as a probe for diagnosing cancer by detecting such a polynucleotide.

Further, the composition of the present invention may be provided as a nucleic acid construct to be introduced into a cell to produce a desired antisense, ribozyme or siRNA in the cell.

When the polynucleotide or the oligonucleotide of the present invention is used as an antisense, ribozyme, siRNA or the like, the polynucleotide or the oligonucleotide may have a chain length of preferably at least 12 nucleotides or more, more preferably 12 to 50 nucleotides, particularly preferably 12 to 25 nucleotides. Such a polynucleotide or oligonucleotide may be a variant in which one or more nucleotides are substituted, added or deleted from the above-mentioned nucleotide sequence, as long as it has a desired antisense, ribozyme or siRNA activity. Such a variant may have a nucleotide sequence with an identity of at least 70%, preferably 90% or more, more preferably 95% or more with the above-mentioned nucleotide sequence. Alternatively, such a polynucleotide or oligonucleotide may hybridize under high stringent conditions to a polynucleotide having a nucleotide sequence represented by any of SEQ ID NOs: 1 to 65.

The term "hybridization" means that DNA or RNA corresponding to the DNA binds to another DNA or RNA molecule by a hydrogen bond interaction in a solution or on a solid support. The strength of such an interaction can be evaluated by changing the stringency of the hybridization conditions. Hybridization conditions having various stringencies may be used depending on the desired specificity and selectivity. The stringency can be adjusted by changing the concentration of a salt or the concentration of a denaturing agent. Such a method of adjusting the stringency is well known in the art and described in, for example, "Molecular Cloning: A Laboratory Manual", Second Edition, Cold Spring Harbor Laboratory Sambrook, Fritsch, & Maniatis, eds., 1989.

The stringent hybridization conditions mean conditions in the presence of 50% formamide at 42° C. in 700 mM NaCl or equivalent conditions. One example of the stringent hybridization conditions is hybridization overnight at 42° C. in a solution containing 50% formamide, 5×SSC, 50 mM $NaH_2PO_4$ (pH 6.8), 0.5% SDS, sonicated salmon sperm DNA (0.1 mg/mL) and 5×Denhardt's solution; washing at 45° C. with 2×SSC and 0.1 SDS; and washing at 45° C. with 2×SSC and 0.1% SDS.

The polynucleotide or the oligonucleotide of the present invention can be produced by a method known to those skilled in the art. For example, it can be synthesized with a commercially available DNA synthesizer (e.g., 394 synthesizer, manufactured by Applied Biosystems) using a protocol known in the art. Alternatively, it can be produced based on the sequence information disclosed in the instant application by the PCR amplification technique well known in the art using a suitable template and primers in combination.

Further, the polynucleotide or the oligonucleotide of the present invention can be prepared by constructing a cDNA library from cells expressing the polypeptide of the present invention and performing hybridization using a probe having a part of the sequence of the polynucleotide of the present invention. The cDNA library may be prepared by, for example, a method described in the document (Sambrook, J. et al., Molecular Cloning, Cold Spring Harbor Laboratory Press (1989)), or a commercially available DNA library may be used. Alternatively, it can be prepared by preparing RNA from cells expressing the polypeptide of the present invention, synthesizing cDNA with a reverse transcriptase, synthesizing oligo-DNA based on the DNA sequence of the present invention (e.g., SEQ ID NO: 1), and amplifying the cDNA encoding the polypeptide of the present invention by PCR using the synthesized oligo-DNA as a primer.

Further, by determining the nucleotide sequence of the obtained cDNA, one can determine the translated region of the cDNA and the amino acid sequence of the protein of the present invention. Further, the obtained cDNA can also be used as a probe for screening a genomic DNA library to isolate genomic DNA.

More specifically, mRNA is first isolated from a cell, tissue (e.g., a lung cancer cell, large bowel cancer cell, liver cancer cell or stomach cancer cell) or the like in which the protein of the present invention is expressed. The isolation of mRNA is carried out by a known method. For example, total RNA is prepared by using guanidine ultracentrifugation (Chirgwin J. M. et al. *Biochemistry* (1979) 18, 5294-5299), or AGPC method (Chomczynski P. and Sacchi N. Anal. Biochem. (1987) 162, 156-159), and mRNA is purified from the total RNA using an mRNA Purification Kit (Pharmacia). Alternatively, mRNA can be directly prepared by using a QuickPrep mRNA Purification Kit (Pharmacia).

From the obtained mRNA, cDNA is synthesized using a reverse transcriptase. The synthesis of cDNA can also be carried out by using AMV Reverse Transcriptase First-strand cDNA Synthesis Kit (Seikagaku Kogyo). Alternatively, cDNA can be synthesized and amplified according to the 5'-RACE method (Frohman M. A. et al. *Proc. Natl. Acad. Sci. U.S.A.* (1988) 85, 8998-9002; Belyavsky A. et al. *Nucleic Acids Res.* (1989) 17, 2919-2932), using a 5'-Ampli FINDER RACE Kit (manufactured by Clontech) and polymerase chain reaction (PCR).

A desired DNA fragment is prepared from the obtained PCR products and ligated to a vector DNA, whereby recombinant vectors are prepared. These recombinant vectors are introduced into *E. coli* or the like, and a desired recombinant vector is prepared by selecting a colony. The nucleotide sequence of the desired DNA can be determined by a known method such as the dideoxynucleotide chain termination method.

By taking into account the frequency of codon usage in the host to be used for expression, the nucleotide sequence of the DNA of the present invention can be designed to be expressed more efficiently (Grantham R. et al. Nucleic Acids Research (1981) 9, r43-74). The DNA of the present invention may be modified by a commercially available kit or by a known method. Examples of the modification include, for example, digestion with a restriction enzyme, insertion of a synthetic oligonucleotide or an appropriate DNA fragment, addition of a linker, insertion of the initiation codon (ATG) and/or a stop codon (TAA, TGA, or TAG).

The oligonucleotide of the present invention may be used as a nucleic acid probe for detecting a cancer-associated gene in a sample. The probe of the present invention is selected to have a nucleotide sequence comprising at least 12, 20, 30, 50, 100 or more consecutive nucleotides of a nucleotide sequence represented by any of SEQ ID NOs: 1 to 65 or a nucleotide sequence complementary thereto, and to hybridize specifically to a specific region of a cancer-associated gene. DNA is extracted from a sample such as tissue or blood, or mRNA is extracted and cDNA is synthesized. DNA or cDNA is brought into contact with the probe under the conditions that allows hybridization to occur, and the presence or the amount of the probe bound to the sample is detected, whereby the presence or amount or variation of the cancer-associated gene or a transcript thereof in the sample can be detected.

The probe may be immobilized on a solid support. Examples of such a solid support include, but are not limited to, plastic, agarose, sepharose, polyacrylamide, latex beads, and nitrocellulose. Techniques to immobilize the probe on such a solid support are well known in the art. The probe can be visualized by labeling with a standard labeling technique such as radioactive labeling, enzymatic labeling (horseradish peroxidase or alkaline phosphatase), fluorescence labeling, biotin-avidin labeling or chemiluminescence. The composition of the present invention can be provided as a kit for detecting the presence of a cancer-associated gene or a transcript thereof in a sample. Such a kit may contain, in addition to the above-mentioned probe, a washing reagent, a reagent that can detect the presence of a bound probe, and a usage guideline.

Alternatively, the diagnostic composition of the present invention may contain a pair of primers that can amplify a nucleotide sequence represented by any of SEQ ID NOs: 1 to 65. With the use of these primers, a desired sequence is amplified by polymerase chain reaction (PCR) by using an appropriate cDNA library as a template. The PCR products are analyzed by a technique such as hybridization or nucleotide sequencing, whereby the presence or amount or variation of the cancer-associated gene or a transcript thereof in a sample can be detected. Such a PCR technique is well known in the art, and described in, for example, "PCR Protocols, A Guide to Methods and Applications", Academic Press, Michael, et al., eds. 1990.

For use as a primer, it is preferred that the oligonucleotide of the present invention has a sequence comprising at least 12, preferably 12 to 50, more preferably 12 to 20 consecutive nucleotides of the nucleotide sequence represented by any of SEQ ID NOs: 1 to 65 or a nucleotide sequence complementary thereto.

The polynucleotide or oligonucleotide of the present invention can silence a cancer-associated gene using an antisense molecule that binds to mRNA encoded by the cancer-associated gene and inhibits its expression, or a ribozyme or siRNA that cleaves mRNA. Methods of controlling gene expression using an antisense, ribozyme or siRNA technique are well known in the art. For example, the composition of the present invention may be administered together with an appropriate carrier, or a vector encoding an antisense, ribozyme or siRNA may be administered to induce its expression in vivo.

The term "ribozyme" means a nucleic acid molecule having an enzymatic activity of cleaving mRNA. The ribozyme generally shows an endonuclease, ligase or polymerase activity. Various types of trans-acting ribozymes such as hammerhead type and the hairpin type ribozymes are known in the art.

The term "antisense" means a nucleic acid molecule or a derivative thereof that hybridizes specifically to genomic DNA and/or mRNA and inhibits its transcription and/or translation to inhibit the expression of the protein. The binding may occur through general base pair complementation, or in the case of binding to DNA duplexes, through specific interactions in the major groove of the double helix. The target site of the antisense nucleic acid is preferably the 5' end of mRNA, for example, the 5'-untranslated sequence up to and including the AUG initiation codon. However, it is known that the 3'-untranslated sequence of mRNA or the sequence of the coding region is also effective in inhibiting the translation of mRNA.

The term "siRNA" means a double-stranded nucleic acid that can effect RNA interference (RNAi) (see, for example, Bass, 2001, *Nature,* 411, 428-429; Elbashir et al., 2001, *Nature,* 411, 494-498). The siRNA can degrade mRNA in a sequence-specific manner, thereby inhibiting the expression of a gene. The siRNA is typically a double-stranded RNA with a length of 20 to 25 base pairs containing a sequence complementary to a target sequence. The siRNA molecule may contain a chemically modified nucleotide or non-nucleotide moiety.

Further, the polynucleotide of the present invention may be used in the production of the protein of the present invention.

Screening

In still another aspect, the present invention provides a method of identifying a compound having an anticancer activity. This method comprises the steps of: bringing a cultured human cell into contact with a test compound; and identifying a compound that causes a change in the expression level of a gene containing a nucleotide sequence represented by any of SEQ ID NOs: 1 to 65 in the cell to be a compound having an anticancer activity.

Any of natural or synthetic compounds may be used as the test compound, and a combinatorial library may also be used. The expression level of a cancer-associated gene in a cell can be conveniently measured by the above-mentioned quantitative PCR method, although any other methods known in the art may be used.

Detection Method

The present invention provides a method of detecting cancer comprising the step of measuring the expression level of the gene or the protein of the present invention. Specific embodiments of the detection method will be described below, however, the detection method of the present invention is not limited to such a method.

In one embodiment of the detection method of the present invention, an RNA sample is first prepared from a subject. Subsequently, the level of RNA encoding the protein of the present invention contained in the RNA sample is measured. Then, the measured RNA level is compared with that of a control. In another embodiment, a cDNA sample is first prepared from a subject. Subsequently, the level of cDNA encoding the protein of the present invention contained in the cDNA sample is measured. Then, the measured cDNA level is compared with that of a control.

Such a method includes any of the methods well known to those skilled in the art, for example, Northern blotting, RT-PCR, DNA array analysis.

In the DNA array analysis, a cDNA sample is prepared by using RNA from a subject as a template, and is brought into contact with a substrate on which the oligonucleotide of the present invention has been immobilized. The intensity of hybridization of the cDNA sample with the nucleotide probe immobilized on the substrate is detected to determine the expression level of the gene of the present invention contained in the cDNA sample. Subsequently, the measured expression level of the gene of the present invention is compared with that of a control.

The cDNA sample may be prepared from a subject by a method well known to those skilled in the art. In a preferred embodiment for preparing the cDNA sample, total RNA is first extracted from cells or tissue (e.g., lung, large bowel, stomach, liver, etc.) of a subject. Total RNA may be extracted by a method well known to those skilled in the art. Total RNA may be extracted by a conventional method or kit that provides highly pure total RNA. For example, a sample is pretreated with "RNA later" (Ambion) and total RNA is extracted using "Isogen" (Nippon Gene). Specific procedures may follow the attached protocols.

Subsequently, cDNA is synthesized with a reverse transcriptase using the extracted total RNA as a template to prepare a cDNA sample. The synthesis of cDNA from total RNA can be carried out by a method well known to those skilled in the art. The prepared cDNA sample is detectably labeled as needed. The labeling substance is not particularly limited as long as it can be detected, and may include fluorescent substances and radioisotopes. cDNA may be labeled by a method generally used by those skilled in the art (L. Luo et al., Gene Expression Profiles of Laser-Captured Adjacent Neuronal Subtypes, Nat. Med., 1999, 117-122).

Those skilled in the art can appropriately determine the intensity of hybridization between cDNA and a nucleotide probe, depending on the type of substance used to label the cDNA sample. For example, when the cDNA is labeled with a fluorescent substance, it can be detected by reading the fluorescent signal with a scanner.

In another embodiment of the detection method of the present invention, a protein sample is first prepared from cells or tissue of a subject. The level of the protein of the present invention contained in the protein sample is measured. Then, the measured protein level is compared with that of a control.

Examples of a method for measurement include SDS polyacrylamide electrophoresis, and methods utilizing the antibody of the invention, such as Western blotting, dot-blotting, immunoprecipitation, enzyme-linked immunosorbent assay (ELISA), and immunofluorescence. Alternatively, it is possible to diagnose cancer by measuring the expression level of the protein of the present invention rather than measuring the expression level of the gene of the present invention.

In the above-mentioned method, the subject is diagnosed to have cancer or to have a high possibility of developing cancer when the expression level of the gene or protein of the present invention increased significantly compared with that of a control.

Further, the present invention provides a diagnostic drug to be used for detecting cancer. Examples of such a test drug include a test drug comprising the oligonucleotide of the present invention (including a substrate on which the oligonucleotide is immobilized), and a diagnostic drug comprising the antibody of the present invention. Any type of antibodies may be used as long as it is suitable for use in a diagnostic test. The antibody is labeled as needed.

The above-mentioned test drug may contain, in addition to the oligonucleotide or the antibody as an active ingredient, sterilized water, physiological saline, a vegetable oil, a surfactant, a lipid, a solubilizing agent, a buffer, a protein stabilizer (such as BSA or gelatin), a preservative or the like.

Detection of C20orf102

In another aspect, the present invention provides a method of diagnosing cancer by detecting C20orf102 protein. The method of the present invention is characterized by detecting C20orf102 protein. C20orf102 is a secretory protein with a secretory signal at the N-terminus, and its amino acid sequence and the gene sequence encoding this sequence are described in GenBank Accession No. NM_080607 (SEQ ID NOs: 2 and 66). In the present invention, C20orf102 protein encompasses both full-length protein and a fragment thereof. The fragment is a polypeptide containing a given domain of C20orf102 protein and it may not have a function of natural C20orf102 protein. The secretory signal of C20orf102 protein corresponds to 1 to 24 amino acids in the amino acid sequence represented by SEQ ID NO: 66 (Psort Prediction: http://psort.nibb.ac.jp/).

In the present invention, it was found that the expression of C20orf102 is elevated at the protein level with a very high frequency in a cancer cell, particularly in lung cancer, liver cancer (e.g., moderately differentiated liver cancer) or pancreatic cancer. In addition, it was shown that immunohistological diagnosis may be carried out by using a monoclonal antibody specific for C20orf102.

The C20orf102 protein to be detected in the present invention is preferably human C20orf102 protein, however, it may be any C20orf102 such as dog C20orf102, cat C20orf102, mouse C20orf102 or hamster C20orf102.

C20orf102 to be detected in the present invention may be C20orf102 of pre-secreted type, however, it is preferably C20orf102 of post-secreted type. C20orf102 is a secretory protein with a secretory signal at the N-terminus, and is secreted to the outside of a cell after being produced in the cell. C20orf102 of post-secreted type means those C20orf102 proteins present outside the cell.

In the present invention, detection includes quantitative or non-quantitative detection. For example, non-quantitative detection includes simple determination of whether or not C20orf102 protein is present, determination of whether or not a predetermined amount or more of C20orf102 protein is present, comparison of the amount of C20orf102 protein with that in another sample (e.g., a control sample, etc.). Quantitative detection includes determination of the concentration of C20orf102 protein, determination of the amount of C20orf102 protein and the like.

The test sample is not particularly limited as long as it may contain C20orf102 protein, but is preferably those collected from the body of an organism such as a mammal, more preferably those collected from human. Specific examples of the test sample include cells, cell homogenate, blood, interstitial fluid, plasma, extravascular fluid, cerebrospinal fluid, synovial fluid, pleural fluid, serum, lymph fluid, saliva, urine and the like, preferably blood, serum or plasma. Further, a sample derived from a test sample, such as a culture solution of cells collected from the body of an organism, is also included in the test sample of the present invention.

Specific examples of the cancer to be diagnosed according to the invention include, but not limited to, liver cancer, pancreatic cancer, lung cancer, large bowel cancer, breast cancer, renal cancer, brain tumor, uterine cancer, lung cancer, stomach cancer, prostate cancer, leukemia, lymphoma and the like. Preferred are lung cancer, liver cancer and pancreatic cancer.

Liver cancer is classified into poorly differentiated liver cancer, moderately differentiated liver cancer, well differentiated liver cancer and the like. Any liver cancer may be detected according to the present invention. Preferably, moderately differentiated liver cancer is detected.

Lung cancer is further classified into lung adenocarcinoma, lung squamous cell carcinoma, lung small cell cancer, lung large cell cancer and the like. Any lung cancer may be detected according to the present invention. Preferably, lung adenocarcinoma is detected.

In the present invention, the subject is diagnosed to have cancer or to have a high possibility of developing cancer when C20orf102 protein is detected in a test sample, or when it is determined that the amount of C20orf102 protein detected in a test sample is higher compared with that of a negative control or a normal healthy subject.

In a preferred embodiment of the diagnostic method of the present invention, the diagnostic method is characterized by detecting C20orf102 protein released from a cell and present in the blood. Particularly preferably, C20orf102 protein or a fragment thereof present in the blood is detected.

C20orf102 protein contained in a test sample may be detected by any methods, but is preferably detected by an immunological method using an anti-C20orf102 antibody. Examples of the immunological method include radioimmunoassay, enzyme immunoassay, fluorescence immunoassay, luminescent immunoassay, immunoprecipitation, immunonephelometry, Western blotting, immunostaining, immunodiffusion method and the like. Preferred is an enzyme immunoassay, and particularly preferred is an enzyme-linked immunosorbent assay (ELISA) (e.g., sandwich ELISA). The above-mentioned immunological methods such as ELISA may be carried out by a method known to those skilled in the art.

For example, a general detection method for detecting C20orf102 protein in a test sample using an anti-C20orf102 antibody may comprise the step of immobilizing the anti-C20orf102 antibody on a support, adding a test sample thereto, incubating the sample to allow for binding the anti-C20orf102 antibody to C20orf102 protein, washing, and detecting C20orf102 protein bound to the support via the anti-C20orf102 antibody.

The support to be used for immobilizing the anti-C20orf102 antibody in the present invention may include an insoluble support made of an insoluble polysaccharide such as agarose or cellulose, a synthetic resin such as a silicon resin, polystyrene resin, a polyacrylamide resin a nylon resin or a polycarbonate resin, glass or the like. Such a support may be used in the form of beads, a plate or the like. In the case of beads, a column may be filled with these beads. A plate may include a multiwell plate (96-multiwell plate or the like), a biosensor chip or the like. The binding of the anti-C20orf102 antibody to the support may be effected by a commonly used method such as via a chemical bond or physical adsorption. All these supports are commercially available.

Usually, the anti-C20orf102 antibody may be bound to C20orf102 protein in a buffer. The buffer may include, for example, a phosphate buffer, a Tris buffer, a citrate buffer, a borate buffer, a carbonate buffer or the like. Incubation may be carried out under commonly used conditions, for example at 4° C. to room temperature for 1 hour to 24 hours. The washing step after the incubation can be carried out in any way as long as it does not inhibit the binding of C20orf102 protein to the anti-C20orf102 antibody, for example, with a buffer containing a surfactant such as Tween 20.

In the method of detecting C20orf102 protein of the present invention, a control sample may be prepared besides the test sample to be analyzed for C20orf102 protein. The control sample includes a negative control sample that does not contain C20orf102 protein and a positive control sample that contains C20orf102 protein. In this case, C20orf102 protein in a test sample can be detected by comparing the result with the result obtained from the negative control sample that does not contain C20orf102 protein, or the result from the positive control sample that contains C20orf102 protein. In addition, a series of control samples having incremental concentrations are prepared, and the results from the respective control samples are obtained as numerical values to create a standard curve. C20orf102 protein contained in a test sample can be quantitatively detected from the numerical value of the result from the test sample based on the standard curve.

In a preferred embodiment, C20orf102 protein bound to the support via the anti-C20orf102 antibody may be detected using an anti-C20orf102 antibody labeled with a labeling substance. For example, a test sample is brought into contact with an anti-C20orf102 antibody immobilized on a support, washed and detected using a labeled antibody that specifically recognizes C20orf102 protein.

The labeling of the anti-C20orf102 antibody may be carried out by a commonly known method. Any of the labeling substances known to those skilled in the art may be used in the invention, such as a fluorescent dye, an enzyme, a coenzyme, a chemiluminescent substance or a radioactive substance. Specific examples include radioisotopes (such as $^{32}P$, $^{14}C$, $^{125}I$, $^{3}H$ and $^{131}I$), fluorescein, rhodamine, dansyl chloride, umbelliferone, luciferase, peroxidase, alkaline phosphatase, β-galactosidase, β-glucosidase, horseradish peroxidase, glucoamylase, lysozyme, saccharide oxidases, microperoxidase, biotin and the like. When biotin is used as a labeling substance, it is preferred that a biotin-labeled antibody is added and then avidin conjugated with an enzyme such as alkaline phosphatase is added. The labeling substance may be bound to the anti-C20orf102 antibody by a known method such as a glutaraldehyde method, a maleimide method, a pyridyl disulfide method or a periodate method.

Specifically, a solution containing an anti-C20orf102 antibody is added to a support such as a plate, and the anti-C20orf102 antibody is immobilized on the support. After the plate is washed, the plate is blocked with, for example, BSA, gelatin, albumin or the like in order to prevent unspecific binding of proteins. Then, the plate is washed again and a test sample is added to the plate. After incubation, the plate is washed a labeled anti-C20orf102 antibody is added. After appropriate incubation, the plate is washed, and the labeled anti-C20orf102 antibody remaining on the plate is detected. The detection can be carried out by a method known to those skilled in the art. For example, in the case where the labeling is carried out with a radioisotope, the protein can be detected by liquid scintillation or an RIA method. In the case where the labeling is carried out with an enzyme, a substrate is added, and the enzymatic change of the substrate such as chromogenic change can be detected with an absorption spectrometer. Specific examples of the substrate include 2,2'-azinobis(3-ethylbenzothiazoline-6-sulfonic acid), diammonium salt (ABTS), 1,2-phenylenediamine (o-phenylenediamine), 3,3', 5,5'-tetramethylbenzidine (TMB) and the like. In the case of a fluorescent substance, the change can be detected with a spectrofluorometer.

In a particularly preferred embodiment of the method of the present invention, C20orf102 protein can be detected with a biotin-labeled anti-C20orf102 antibody and avidin.

Specifically, a solution containing an anti-C20orf102 antibody is added to a support such as a plate, and the anti-C20orf102 antibody is immobilized thereon. After the plate is washed, the plate is blocked with, for example BSA in order to prevent unspecific binding of proteins. Then, the plate is washed again and a test sample is added to the plate. After incubation, the plate is washed and a biotin-labeled anti-C20orf102 antibody is added. After appropriate incubation, the plate is washed, and avidin bound to an enzyme such as alkaline phosphatase or peroxidase is added to the plate. After incubation, the plate is washed and a substrate corresponding to the enzyme bound to avidin is added, and then C20orf102 protein is detected through the enzymatic change of the substrate as an indicator.

In another embodiment of the method of the present invention, C20orf102 protein can be detected using one or more types of primary antibodies specifically recognizing C20orf102 protein and one or more types of secondary antibodies specifically recognizing the primary antibodies.

For example, a test sample is brought into contact with one or more types of anti-C20orf102 antibodies immobilized on a support, the support is incubated and washed, and then C20orf102 protein bound after washing is detected by the primary anti-C20orf102 antibodies and one or more types of secondary antibodies specifically recognizing the primary antibodies. In this case, the secondary antibodies are preferably labeled with a labeling substance.

In another embodiment of the method of the present invention, C20orf102 protein can be detected by an agglutination reaction. In this method, C20orf102 can be detected using a support sensitized with an anti-C20orf102 antibody. The support sensitized with an anti-C20orf102 antibody may be of any types as long as it is insoluble, does not cause a non-specific reaction, and is stable. Such a support include, for example, latex particles, bentonite, collodion, kaolin, fixed sheep erythrocytes or the like. It is preferred to use latex particles. The latex particles may include polystyrene latex particles, styrene-butadiene copolymer latex particles, polyvinyltoluene latex particles or the like. It is preferred to use polystyrene latex particles. Sensitized particles are mixed with a sample, and stirred for a certain period of time. The degree of agglutination of the particles becomes higher as the concentration of anti-C20orf102 antibody contained in the sample is higher, therefore, C20orf102 can be detected by observing the agglutination with the naked eye. In addition, the protein can be detected by measuring the turbidity due to agglutination with a spectrophotometer.

In another embodiment of the method of the present invention, C20orf102 protein can be detected with a biosensor based on the surface plasmon resonance phenomenon. With the biosensor based on the surface plasmon resonance phenomenon, the protein-protein interaction can be observed with a small amount of unlabeled protein in real time as indicated by a surface plasmon resonance signal. For example, binding of the anti-C20orf102 antibody to C20orf102 protein can be detected with a biosensor such as BIAcore (manufactured by Amersham Biosciences). Specifically, a test sample is brought into contact with a sensor chip on which an anti-C20orf102 antibody has been immobilized, and then C20orf102 protein bound to the anti-C20orf102 antibody can be detected as a change in the resonance signal.

The detection method of the present invention can be automated using various automatic testing device, where a large number of samples can be tested at once.

It is also an object of the present invention to provide a diagnostic drug or kit for detecting C20orf102 protein in a test sample for diagnosis of cancer, where the diagnostic drug or kit contains at least the anti-C20orf102 antibody. In the case where the diagnostic drug or kit is based on an EIA method such as an ELISA method, the drug or kit may contain a support for immobilizing the antibody, or the antibody may be immobilized on the support in advance. In the case where the diagnostic drug or kit is based on the agglutination method using a support such as latex, the drug or kit may contain a support to which the antibody has been adsorbed. In addition, the kit may contain a blocking solution, a reaction solution, a reaction termination solution, a reagent for treating a sample or the like as needed.

Production of Anti-C20orf102 Antibody

The anti-C20orf102 antibody to be used in the present invention may be of any origin, of any type (monoclonal or polyclonal), and of any form, as long as it specifically binds to C20orf102 protein. Specifically, any of known antibodies can be used in the invention, such as a mouse antibody, a rat antibody, a human antibody, a chimeric antibody or a humanized antibody. The antibody may be a polyclonal antibody, but is preferably a monoclonal antibody.

Further, an anti-C20orf102 antibody to be immobilized on a support and an anti-C20orf102 antibody to be labeled with a labeling substance may recognize the same epitope of the C20orf102 molecule, but preferably recognize different epitopes. The sites to be recognized are not particularly limited.

The anti-C20orf102 antibody to be used in the present invention can be obtained as a polyclonal antibody or a monoclonal antibody by a known technique. A monoclonal antibody derived from a mammal is particularly preferred as the anti-C20orf102 antibody to be used in the present invention. Examples of the monoclonal antibody derived from a mammal include those produced by a hybridoma and those produced by a host transformed with an expression vector containing a genetically engineered antibody gene.

A monoclonal antibody-producing hybridoma can be principally produced using a known technique as follows. An animal is immunized with C20orf102 as a sensitizing antigen according to a common immunization method. The immunocyte is obtained and fused with a known parent cell by a common cell fusion method. A cell producing a monoclonal antibody is screened by a common screening method.

Specifically, a monoclonal antibody can be produced as follows.

First, C20orf102 to be used as a sensitizing antigen for obtaining an antibody is prepared by expressing C20orf102 gene/amino acid sequence described in GenBank Accession No. NM_080607. More specifically, the gene sequence encoding C20orf102 is inserted into a known vector system, an appropriate host cell is transformed with the vector, and then, a desired human C20orf102 protein of interest is purified by a known method from the host cell or the culture supernatant thereof. Alternatively, C2.0orf 102 protein may be purified from a natural source.

Subsequently, the purified C20orf102 protein is used as a sensitizing antigen. Alternatively, a partial peptide of C20orf102 can be used as a sensitizing antigen. In this case, the partial peptide can be obtained by chemical synthesis based on the an amino acid sequence of human C20orf102, or by introducing a portion of C20orf102 gene into an expression vector, or by digesting native C20orf102 with a protease. Any site and size of C20orf102 may be used as a partial peptide.

Any types of mammal may be immunized with the sensitizing antigen, but is preferably selected in consideration of its compatibility with the parent cell to be used in cell fusion. Generally a mammal include a rodent such as a mouse, a rat or a hamster, or a rabbit, a monkey or the like.

An animal is immunized with a sensitizing antigen using a known method. In a commonly used method, the sensitizing antigen is injected into the mammal intraperitoneally or subcutaneously. Specifically, a sensitizing antigen is diluted and suspended in an appropriate amount of phosphate buffered saline (PBS), physiological saline or the like, and mixed with an appropriate amount of a common adjuvant such as Freund's complete adjuvant as needed. After being emulsified, it is administered to a mammal for several times every 4 to 21 days. Additionally a suitable carrier may be used upon immunization of the sensitizing antigen. In particular, when a partial peptide with a small molecular weight is used as a sensitizing antigen, it is preferred to bind it to a carrier protein such as albumin or keyhole limpet hemocyanin for immunization.

After a mammal is immunized as described above and the increase in the desired antibody level in the serum is observed, the immunocytes are taken out from the mammal and are subjected to cell fusion. Preferred immunocytes include, in particular, the spleen cells.

A mammalian myeloma cell may also be used as a parent cell for cell fusion with the above-mentioned immunocyte. Preferably, known variety cell lines are used as the myeloma cell such as P3 (P3x63Ag8.653) (*J. Immunol.* (1979) 123, 1548-1550), P3x63Ag8U.1 (*Current Topics in Microbiology and Immunology* (1978) 81, 1-7), NS-1 (Kohler, G. and Milstein, C., *Eur. J. Immunol.* (1976) 6, 511-519), MPC-11 (Margulies, D. H. et al., Cell (1976) 8, 405-415), SP2/0 (Shulman, M. et al., *Nature* (1978) 276, 269-270), FO (de St. Groth, S. F. et al., *J. Immunol. Methods* (1980) 35, 1-21), S194 (Trowbridge, I. S., J. Exp. Med. (1978) 148, 313-323), and R210 (Galfre, G. et al., *Nature* (1979) 277, 131-133).

The cell fusion between the immunocyte and the myeloma cell may be carried out principally according to a known method such as a method of Kohler and Milstein et al. (Kohler, G. and Milstein, C., Methods Enzymol. (1981) 73, 3-46).

More specifically, the above-mentioned cell fusion is carried out in a usual nutritional medium in the presence of, for example, a cell fusion-promoting agent. The cell fusion-promoting agent include, for example, polyethyleneglycol (PEG), Sendai virus (HVJ) or the like. An auxiliary agent such as dimethylsulfoxide can also be used to increase the fusion efficiency as needed.

The ratio of the number of the immunocyte to the myeloma cell to be used may be appropriately determined. For example, the number of the immunocyte is preferred to be set at 1 to 10 times that of the myeloma cell. The culture medium to be used in the above-mentioned cell fusion includes culture media suitable for the growth of the above-mentioned myeloma cell line, for example, RPMI 1640 culture medium and MEM culture medium, and a standard culture medium which is used for this type of cell culture. Further, a serum supplement such as fetal calf serum (FCS) may be used in combination.

In cell fusion, predetermined number of above-mentioned immunocytes and myeloma cells are thoroughly mixed in the above-mentioned culture medium, a PEG solution previously heated to about 37° C. (for example, an average molecular weight of about 1000 to 6000) is added at a concentration of 30 to 60% (w/v) and mixed to form a desired fusion cell (hybridoma). Then, the process of sequential addition of an appropriate culture medium, centrifugation and removal of a supernatant is repeated to remove the cell fusion agent and those which are undesirable for the growth of the hybridoma.

The resulting hybridoma is then selected by culturing it in a standard selection culture medium such as HAT culture medium (a culture medium containing hypoxanthine, aminopterin, and thymidine). The cultivation in the above-mentioned HAT culture medium is continued for sufficient time (usually from several days to several weeks) so that cells other than the desired hybridoma (non-fused cells) will die. Then, a hybridoma that produces a desired antibody is screened and monocloned by a standard limiting dilution method.

A desired antibody may be screened and monocloned by a known screening method based on an antigen-antibody reaction. For example, an antigen is bound to a support such as beads made of polystyrene or the like or a commercially available 96-well microtiter plate, then a culture supernatant of hybridoma is added. After the support is washed, an enzyme-labeled secondary antibody or the like is added to determine whether or not a desired antibody reacting with the sensitizing antigen is contained in the culture supernatant. The hybridoma that produces a desired antibody can be cloned by a limiting dilution method or the like. The antigen used for immunization may be used in the screening procedure.

In addition to the above-mentioned method where an animal other than human is immunized with an antigen to obtain a hybridoma, it is also possible to sensitize a human lymphocyte in vitro with C20orf102, and the resulting sensitized lymphocyte is fused with a human myeloma cell having the ability to divide permanently, whereby a desired human antibody having the activity of binding to C20orf102 can be obtained (see JP-B-1-59878). Alternatively, C20orf102 is administered to a transgenic animal having the repertoire of all the genes for human antibody to obtain a cell producing the anti-C20orf102 antibody. The cell is immortalized and a human antibody against C20orf102 may be obtained from the immortalized cell (see International Patent Application Publication Nos. WO 94/25585, WO 93/12227, WO 92/03918 and WO 94/02602).

The thus prepared hybridoma that produces a monoclonal antibody can be subcultured in a standard culture medium, or can be stored for a long period of time in liquid nitrogen.

In order to obtain a monoclonal antibody from the hybridoma, the hybridoma is cultured according to a standard method and an antibody is obtained as the culture supernatant alternatively, the hybridoma is administered to and grown in a mammal compatible with the hybridoma and an antibody is obtained as the ascites or the like. The former method is suitable for obtaining high-purity antibodies, whereas the latter is suitable for mass production of antibodies.

According to the present invention, a recombinant monoclonal antibody produced by genetic engineering techniques can also be used as a monoclonal antibody. The antibody gene is cloned from the hybridoma, introduced into an appropriate vector and introduced into the host cell to produce a recombinant-type monoclonal antibody (see, for example, Vandamme, A. M. et al., Eur. J. Biochem. (1990) 192, 767-775, 1990). Specifically, mRNA encoding the variable (V) region of the anti-C20orf102 antibody is isolated from the hybridoma producing the anti-C20orf102 antibody. The isolation of mRNA is carried out by a known method such as guanidine ultracentrifugation (Chirgwin, J. M. et al. Biochemistry (1979) 18, 5294-5299) or the AGPC method (Chomczynski, P. et al., Anal. Biochem. (1987) 162, 156-159) to prepare total RNA, and then a desired mRNA is prepared by using an mRNA Purification Kit (manufactured by Pharmacia). Alternatively, mRNA can be directly prepared by using a Quick-Prep mRNA Purification Kit (manufactured by Pharmacia).

cDNA coding for the variable (V) region of the antibody is synthesized from the resulting mRNA by using a reverse transcriptase. The synthesis of the cDNA is carried out by using AMV Reverse Transcriptase First-strand cDNA Synthesis Kit (manufactured by Seikagaku Kogyo) or the like. Alternatively, cDNA may be synthesized and amplified by the 5'-RACE method (Frohman, M. A. et al., Proc. Natl. Acad. Sci. USA (1988) 85, 8998-9002, Belyavsky, A. et al., Nucleic Acids Res. (1989) 17, 2919-2932) using a 5'-Ampli FINDER RACE Kit (manufactured by Clontech), PCR and the like.

The desired DNA fragment is purified from the resulting PCR product and ligated with a vector DNA. Then a recombinant vector is constructed therefrom and introduced into E. coli or the like, and a colony is selected, whereby a desired recombinant vector is prepared. The nucleotide sequence of the desired DNA is checked by a known method such as the dideoxy nucleotide chain termination method.

Once the desired DNA encoding the V region of the anti-C20orf102 antibody is obtained, and the DNA is incorporated integrated into an expression vector containing DNA encoding the constant region (C region) of a desired antibody.

In order to produce the anti-C20orf102 antibody to be used in the present invention, the antibody gene is incorporated into an expression vector so as to be expressed under the control of the expression regulatory region, for example, an enhancer or a promoter. Subsequently, a host cell is transformed with the expression vector, and the antibody is expressed in the cell.

The antibody gene may be expressed in the cell by separately introducing DNAs encoding the heavy chain (H chain) and the light chain (L chain) of the antibody into expression vectors and co-transforming a host cell with the vectors; or by introducing DNAs encoding the H chain and the L chain into a single expression vector and transforming a host cell with the vector (see WO 94/11523).

In addition to the above-mentioned host cell, a transgenic animal can be used for the production of a recombinant antibody. For example, an antibody gene is inserted into the middle of a gene encoding a protein produced specifically into milk (such as goat β-casein) to prepare a fusion gene. A DNA fragment containing the fusion gene comprising the antibody gene is injected into a goat's embryo, which is then introduced into a female goat. A desired antibody can be obtained from milk produced by a transgenic goat which is born from the goat that had received the embryo or offspring thereof. To increase the amount of milk containing the desired antibody produced by the transgenic goat, an appropriate hormone may be administered to the transgenic goat (Ebert, K. M. et al., Bio/Technology (1994) 12, 699-702).

In addition to the above-mentioned antibodies, an artificially modified genetic recombinant-type antibody, such as a chimeric antibody or a humanized antibody can be used in the present invention. Such a modified antibody can be produced by using a known method.

The chimeric antibody may be obtained by ligating the DNA encoding the v region of the antibody obtained as described above with DNA encoding the C region of a human antibody, introducing the resulting DNA into an expression vector, and introducing the vector into a host for production of the antibody. By using this known method, a chimeric antibody useful for the present invention can be obtained.

A humanized antibody, also referred to as a "reshaped humane antibody", is obtained by grafting the complementarity determining region (CDR) of an antibody from a non-human mammal, such as a mouse, into the complementarity determining region of a human antibody. A general technique of genetic recombination is also known in the art (see European Patent Application EP125023 and WO 96/02576).

Specifically, a DNA sequence designed to ligate a mouse antibody CDR to the framework region (FR) of a human antibody is synthesized by PCR using as primers several oligonucleotides constructed to have overlapping portions at the ends of both CDR and FR (see the method described in WO 98/13388).

The framework region of the human antibody to be ligated via the CDR is selected such that the complementarity determining region will form a favorable antigen-binding site. As necessary, amino acids in the framework region of an antibody variable region may be substituted, so that the complementarity determining region of a reshaped human antibody forms an appropriate antigen-binding site (Sato, K. et al., Cancer Res. (1993) 53, 851-856).

C regions from the human antibody is used as the C region in the chimeric antibody or the humanized antibody. For example, Cγ1, Cγ2, Cγ3 or Cγ4 can be used for the H chain, and Cκ or Cλ can be used for the L chain. The C region of the human antibody may be modified in order to improve the stability of the antibody itself or the production process.

A chimeric antibody is composed of the variable region of an antibody derived from a non-human mammal and the constant region derived from a human antibody on the other hand, a humanized antibody is composed of the complementarity determining region of an antibody derived a non-human mammal, and the framework region and the constant region derived from a human antibody. Since the antigenicity of the humanized antibody is expected to be reduced in human body, the humanized antibody is useful as an active ingredient of a therapeutic agent of the present invention.

The antibody to be used in the present invention is not limited to the whole antibody molecule and may be a fragment of the antibody or a modified fragment thereof as long as it binds to C20orf102. It includes a divalent antibody and a monovalent antibody. Examples of the fragment of the antibody include Fab, F(ab')2, Fv, Fab/c having one Fab and a full Fc, and a single chain Fv (scFv) where the Fv of the H chain and the L chain are linked via an appropriate linker. Specifically, an antibody is treated with an enzyme such as papain or pepsin to provide a fragment of the antibody. Alternatively, a gene encoding such an antibody fragment is constructed and introduced into an expression vector, and the antibody fragment is expressed in a suitable host cell (see, for example, Co, M. S. et al., J. Immunol. (1994) 152, 2968-2976, Better, M. &Horwitz, A. H. Methods in Enzymology (1989) 178, 476-496, Academic Press, Inc., Plueckthun, A. & Skerra, A. Methods in Enzymology (1989) 178, 476-496, Academic Press, Inc., Lamoyi, E., Methods in Enzymology (1989) 121, 652-663, Rousseaux, J. et al., Methods in Enzymology (1989) 121, 663-669, Bird, R. E. et al., TIBTECH (1991) 9, 132-137).

The scFv can be obtained by linking the H chain V region and the L chain V region of an antibody. In the scFv, the H chain V region and the L chain V region are preferably linked via a linker, preferably a peptide linker (Huston, J. S. et al., Proc. Natl. Acad. Sci. U.S.A. (1988) 85, 5879-5883). The H chain V region and the L chain V region in scFv may be derived from any antibody described as an antibody in this specification. For example, any single chain peptide having 12 to 19 amino acid residues may be used as the peptide linker for ligating the V regions.

DNA encoding scFv can be obtained by amplifying a fragment by PCR using as a template a DNA portion encoding all or a desired amino acid sequence of the sequences of DNA encoding the H chain or the H chain V region of the above-mentioned antibody and DNA encoding the L chain or the L chain V region of the above-mentioned antibody with a primer pair that defines the both ends thereof. Then the fragment is: amplified with a combination of DNA encoding a peptide linker portion and a primer pair which defines both ends to be ligated to the H chain and the L chain.

Once DNA encoding scFv is prepared, an expression vector containing the DNA and a host cell transformed with the expression vector can be obtained according to a standard method. The scFv can be obtained from such a host according to a standard method.

These antibody fragments can be produced in a host by obtaining the gene thereof in the same manner as described above and by allowing it to be expressed. The term "antibody" in the present invention also encompasses these antibody fragments.

A modified antibody, for example, an anti-C20orf102 antibody conjugated with any of a variety of molecules such as a labeling substance can also be used in the invention. The term "antibody" in the present invention also encompasses such a modified antibody. Such a modified antibody can be obtained by chemically modifying the antibody obtained as above. Methods of modifying an antibody have already been established in the art.

Further, the antibody to be used in the present invention may be a bispecific antibody. The bispecific antibody may have antigen-binding sites that recognize different epitopes on the C20orf102 molecule. Alternatively, one of which may recognize C20orf102, and the other may recognize a labeling substance or the like. The bispecific antibody can also be produced by ligating an HL pair of two types of antibodies, or by fusing hybridomas producing different monoclonal antibodies to provide a fusion cell producing the bispecific antibody. Furthermore, the bispecific antibody can also be produced by genetic engineering techniques.

Antibodies can be expressed from the antibody gene constructed as described above by a known method. In the case of a mammalian cell, the gene can be expressed by operably linking a conventional useful promoter, an antibody gene to be expressed and a poly A signal at the 3'-downstream of the gene. A promoter/enhancer includes, for example, a human cytomegalovirus immediate early promoter/enhancer.

Further, examples of the promoter/enhancer used for expressing antibodies to be used in the present invention include, for example, viral promoter/enhancers such as retrovirus, polyoma virus, adenovirus and simian virus 40 (SV40), mammalian promoter/enhancers such as human elongation factor 1α (HEF1α).

Antibodies can be readily expressed by the method of Mulligan et al. (*Nature* (1979) 277, 108) when SV40 promoter/enhancer is used, and by the method of Mizushima et al. (*Nucleic Acids Res.* (1990) 18, 5322) when HEF1α promoter/enhancer is used.

In the case of *E. coli*, the gene can be expressed by operably linking a conventional useful promoter, a signal sequence for antibody secretion and an antibody gene to be expressed. A promoter includes, for example, lacZ promoter and araB promoter. The gene can be expressed by the method of Ward et al. (*Nature* (1989) 341, 544-546; *FASEB J.* (1992) 6, 2422-2427) when the lacZ promoter is used, and by the method of Better et al. (*Science* (1988) 240, 1041-1043) when the araB promoter is used.

A signal sequence for antibody secretion may be used for producing the antibody in the periplasm of *E. coli*, such as pelB signal sequence (Lei, S. P. et al., *J. Bacteriol.* (1987) 169, 4379). After isolating the antibody produced in the periplasm, the antibody is appropriately refolded for use.

A replication origin may be derived from SV40, polyoma virus, adenovirus, bovine papilloma virus (BPV). To amplify the gene copy number in a host cell system, the expression vector may contain as a selection marker the aminoglycoside transferase (APH) gene, the thymidine kinase (TK) gene, the *E. coli* xanthine guanine phosphoribosyl transferase (Ecogpt) gene, the dihydrofolate reductase (dhfr) gene or the like.

Any expression system, for example, a eukaryotic cell or a prokaryotic cell can be used for producing the antibody to be used in the present invention. Examples of the eukaryotic cell include established animals cells such as mammalian cells, insect cells, filamentous fungus cells, and yeast cells and the like. Examples of the prokaryotic cell include bacteria cells such as *E. coli* cells.

The antibody to be used in the present invention is preferably expressed in a mammalian cell such as a CHO, COS, myeloma, BHK, Vero, or Hela cell.

Subsequently, the transformed host cell is cultured in vitro or in vivo to produce a desired antibody. The host cell may be cultured according to a known method. For example, DMEM, MEM, RPMI1640 and IMDM can be used as a culture medium, and a serum supplement such as fetal calf serum (FCS) may be used in combination.

The thus expressed and produced antibody can be isolated from the cell or the host animal and purified to homogeneity. The isolation and purification of the antibody to be used in the present invention can be carried out by using an affinity column. Examples of a Protein A column include Hyper D, POROS, Sepharose F. F. (manufactured by Pharmacia). Any other standard methods for isolation and purification of proteins may be used in the invention. For example, the antibody can be isolated and purified by appropriately selecting and combining chromatography columns, besides the above-mentioned affinity columns, filters, ultra filtration, salting-out, dialysis and the like (*Antibodies A Laboratory Manual*, Ed Harlow, David Lane, Cold Spring Harbor Laboratory, 1988).

Cancer-Associated Gene of the Present Invention

A list of the cancer-associated genes identified in the present invention is shown in Table 1 with its name, a cancer tissue in which the expression of the gene is elevated, and SEQ ID NOs of the sequence of the gene and the sequence of a protein encoded by the gene.

TABLE 1

| No | Gene name | GenBank | Ref. ID | Cancer type in which expression is elevated | Gene SEQ ID NO | Amino acid SEQ ID NO |
|---|---|---|---|---|---|---|
| TEG1 | C20orf102 | AA206763 | NM_080607 | Lung cancer, Moderately differentiated liver cancer, Pancreatic cancer | 2 | 66 |
| TEG2 | ASCL2 | AI393930 | | Stomach cancer, Large bowel cancer, Lung cancer, Pancreatic cancer, Metastatic tissue of large bowel cancer (liver) | 3 | 67 |
| TEG3 | EST | BE645480 | | Stomach cancer, Moderately differentiated liver cancer, Large bowel cancer, Lung cancer, Pancreatic cancer, Metastatic tissue of large bowel cancer (liver) | 4 | |
| TEG4 | EST | AA447317 | | Stomach cancer, Large bowel cancer, Metastatic tissue of large bowel cancer (liver) | 5 | |
| TEG5 | EST | AI217375 | | Stomach cancer, Pancreatic cancer | 6 | |
| TEG6 | OK/SW-CL . . . 30 | AI217375 | | Lung cancer, Stomach cancer, Large bowel cancer, Moderately differentiated liver cancer | 7 | 68 |
| TEG7 | DKFZp686L1533 | BG492359 | | Lung cancer, Stomach cancer, Large bowel cancer, Moderately or poorly differentiated liver cancer, Metastatic tissue of large bowel cancer (liver) | 8 | |
| TEG8 | EST | BF825703 | | Stomach cancer, Poorly differentiated liver cancer, Lung cancer | 10 | 69 |
| TEG9 | LOC93082 | AL389981.1 | | Stomach cancer, Poorly differentiated liver cancer, Pancreatic cancer, Metastatic tissue of large bowel cancer (liver) | 11 | 70 |
| TEG10 | EST | BG285837 | | Stomach cancer, Moderately or poorly differentiated liver cancer, Lung cancer | 12 | |
| TEG11 | FLJ11041 | AI343467 | | Stomach cancer, Large bowel cancer, Moderately/ differentiated liver cancer, Lung cancer, Pancreatic cancer, Metastatic tissue of large bowel cancer (liver) | 13 | 71 |
| TEG12 | EST | BF057073 | | Liver cancer | 15 | 72 |
| TEG13 | EST | H66658 | | Liver cancer | 16 | |

TABLE 1-continued

| No | Gene name | GenBank | Ref. ID | Cancer type in which expression is elevated | Gene SEQ ID NO | Amino acid SEQ ID NO |
|---|---|---|---|---|---|---|
| TEG14 | ASPM | NM_018123.1 | | Stomach cancer, Large bowel cancer, Liver cancer, Lung cancer | 17 | 73 |
| TEG15 | Sp5 | AI380207 | | Stomach cancer, Large bowel cancer, Liver cancer, Lung cancer | 18 | 74 |
| TEG16 | IMAGE: 297403 | AF339813.1 | | Liver cancer, Lung cancer, Pancreatic cancer, Metastatic tissue of large bowel cancer (liver) | 19 | |
| TEG17 | DKFZp434K2435 | AL136855.1 | NM_032256 | Stomach cancer, Large bowel cancer, Liver cancer, Pancreatic cancer | 20 | 75 |
| TEG18 | CBRC7TM_249 | AI694413 | | Stomach cancer, Large bowel cancer, Moderately or poorly differentiated liver cancer, Pancreatic cancer, Metastatic tissue of large bowel cancer (liver) | 22 | 76 |
| TEG19 | MASS1/VLGR1 | AF055084.1 | NM_032119 | Lung cancer, Pancreatic cancer | 1 | 77 |
| TEG20 | C20orf54 | AA903862 | NM_033409 | Stomach cancer, Large bowel cancer, Lung cancer, Metastatic tissue of large bowel cancer (liver) | 9 | 78 |
| TEG21 | RHBG | NM_020407.1 | NM_020407 | Liver cancer | 14 | 79 |
| TEG22 | COPG2 | AB047847.1 | NM_012133 | Large bowel cancer, Lung cancer | 21 | 80 |
| TEG23 | EST | | | Poorly differentiated liver cancer, Lung cancer | 64,65 | 81,82 |
| TEG24 | EST | BE670584 | | Stomach cancer, Lung cancer, Metastatic tissue of large bowel cancer (liver) | 23 | 83 |
| TEG25 | GPR49 | AL524520 | NM_003667 | Stomach cancer, Large bowel cancer, Moderately differentiated liver cancer, Lung cancer, Metastatic tissue of large bowel cancer (liver) | 24 | 84 |
| TEG26 | MUC17 | AK026404.1 | | Stomach cancer, Pancreatic cancer | 25 | 85 |
| TEG27 | EphB2 | AF025304.1 | NM_004442 | Stomach cancer, Large bowel cancer, Lung cancer, Metastatic tissue of large bowel cancer (liver) | 26 | 86 |
| TEG28 | FLJ11856/GPCR41 | AK021918.1 | NM_024531 | Stomach cancer, Large bowel cancer, Lung cancer, Metastatic tissue of large bowel cancer (liver), Pancreatic cancer | 27 | 87 |
| TEG29 | HS6ST2 | AI767756 | | Lung cancer, Large bowel cancer, poorly differentiated liver cancer, Pancreatic cancer | 28 | 88 |
| TEG30 | PCDHB2 | NM_018936.1 | NM_018936 | Lung cancer, Pancreatic cancer | 29 | 89 |
| TEG31 | WFDC3 | AL050348 | | Lung cancer, Pancreatic cancer | 30 | 90 |
| TEG32 | C20orf42 | NM_017671.1 | NM_017671 | Lung cancer, Stomach cancer, Large bowel cancer, Metastatic tissue of large bowel cancer (liver), | 31 | 91 |
| TEG33 | PIGR | NM_002644.1 | NM_002644 | Lung cancer, Large bowel cancer | 32 | 92 |
| TEG34 | NFE2L3 | NM_004289.3 | NM_004289 | Stomach cancer, Large bowel cancer, Lung cancer, Metastatic tissue of large bowel cancer (liver), Pancreatic cancer | 33 | 93 |
| TEG35 | TRAG3 | NM_004909.1 | NM_004909 | Stomach cancer, Lung cancer, Pancreatic cancer | 34 | 94 |
| TEG36 | TRIM31 | NM_007028 | | Stomach cancer, Pancreatic cancer, Lung cancer | 35 | 95 |
| TEG37 | KIAA1359 | AB037780 | | Stomach cancer, Lung cancer, Large bowel cancer, Pancreatic cancer, Metastatic tissue of large bowel cancer (liver) | 36 | 96 |
| TEG38 | ubiquitinD | NM_006398 | | Stomach cancer, Large bowel cancer, Lung cancer, Moderately or poorly differentiated liver cancer, Lung cancer, Pancreatic cancer | 37 | 97 |
| TEG39 | Hephaestin | NM_014799.1 | NM_014799 | Stomach cancer, Metastatic tissue of large bowel cancer (liver), Pancreatic cancer | 38 | 98 |
| TEG40 | KIAA0152 | BC000371.1 | NM_014730 | Stomach cancer, Large bowel cancer, Glioblastoma, Lung cancer | 39 | 99 |
| TEG41 | KIAA0703 | NM_014861.1 | NM_014861 | Stomach cancer, Lung cancer, Metastatic tissue of large bowel cancer (liver) | 40 | 100 |
| TEG42 | MEST/PEG1 | NM_002402.1 | NM_002402 | Stomach cancer, Large bowel cancer, Lung cancer | 41 | 101 |
| TEG43 | KIAA1199 | AB033025.1 | | Stomach cancer, Lung cancer, Large bowel cancer, Pancreatic cancer | 42 | 102 |
| TEG44 | ELOVL2 | BF508639 | NM_017770 | Liver cancer, Glioblastoma, Lung cancer | 43 | 103 |
| TEG45 | ROBO1 | BF059159 | NM_133631 | Liver cancer, Glioblastoma, Lung cancer | 44 | 104 |
| TEG46 | FLJ10504/misato | BC002535.1 | NM_018116 | Liver cancer, Lung cancer, Pancreatic cancer | 45 | 105 |
| TEG47 | cystatin SN | NM_001898.1 | NM_001898 | Large bowel cancer, Lung cancer | 46 | 106 |
| TEG48 | LOC116238 | BE328850 | NM_138463 | Stomach cancer, Large bowel cancer, Lung cancer, Poorly differentiated liver cancer, Pancreatic cancer | 47 | 107 |
| TEG49 | MRPL50 | BG028213 | NM_019051 | Stomach cancer, Large bowel cancer, Moderately or poorly differentiated liver cancer, Glioblastoma, Lung cancer, Pancreatic cancer | 48 | 108 |
| TEG50 | TOP1MT | AW592604 | NM_052963 | Large bowel cancer, Poorly differentiated liver cancer, Metastatic tissue of large bowel cancer (liver), Pancreatic cancer | 49 | 109 |
| TEG51 | FKSG14 | BC005400.1 | NM_022145 | Stomach cancer, Large bowel cancer, Lung cancer, Pancreatic cancer | 50 | 110 |
| TEG52 | CDH3 | NM_001793.1 | NM_001793 | Lung cancer, Stomach cancer, Large bowel cancer, Pancreatic cancer | 51 | 111 |
| TEG53 | NRP2 | N90777 | NM_003872 | Lung cancer, Glioblastoma, Metastatic tissue of large bowel cancer (liver), Pancreatic cancer | 52 | 112 |
| TEG54 | CLDN3 | BE791251 | NM_001306 | Stomach cancer, Lung cancer, Large bowel cancer, Metastatic tissue of large bowel cancer (liver) | 53 | 113 |

TABLE 1-continued

| No | Gene name | GenBank | Ref. ID | Cancer type in which expression is elevated | Gene SEQ ID NO | Amino acid SEQ ID NO |
|---|---|---|---|---|---|---|
| TEG55 | CLDN4 | NM_001305.1 | NM_001305 | Stomach cancer, Lung cancer, Large bowel cancer, Metastatic tissue of large bowel cancer (liver), Pancreatic cancer | 54 | 114 |
| TEG56 | SFRP4 | AW089415 | NM_003014 | Lung cancer, Stomach cancer, Glioblastoma, Pancreatic cancer | 55 | 115 |
| TEG57 | ASPSCR1 | NM_024083.1 | NM_024083 | Liver cancer, Lung cancer | 56 | 116 |
| TEG58 | GAGEC1 | NM_007003.1 | NM_007003 | Liver cancer | 57 | 117 |
| TEG59 | RHAMM | NM_012485.1 | NM_012484 | Stomach cancer, Large bowel cancer, Liver cancer, Pancreatic cancer | 58 | 118 |
| TEG60 | PEG10 | BE858180 | NM_015068 | Liver cancer, Lung cancer, Hepatoblastoma | 59 | 119 |
| TEG61 | PAEP | NM_002571.1 | NM_002571 | Lung cancer, Pancreatic cancer | 60 | 120 |
| TEG62 | MGC10981 | BC004397.1 | NM_032654 | Lung cancer, Pancreatic cancer | 61 | 121 |
| TEG63 | DUSP9 | NM_001395.1 | NM_001395 | Liver cancer | 62 | 122 |
| TEG64 | EST1B | AB029012.1 | | Liver cancer, Lung cancer, Pancreatic cancer | 63 | 123 |

TEG1 (SEQ ID NO: 2; SEQ ID NO: 66) encodes C20orf102. The GenBank accession number of the gene is AA206763 (reference sequence ID: NM_080607). It was found that the expression of the gene is elevated in lung cancer, moderately differentiated liver cancer and pancreatic cancer. It is not known that the expression of the gene is associated with cancer.

TEG2 (SEQ ID NO: 3; SEQ ID NO: 67) encodes EST (ASCL2). The GenBank accession number of the gene is AI393930. It was found that the expression of the gene is elevated in stomach cancer, large bowel cancer, lung cancer, pancreatic cancer and metastatic tissue of large bowel cancer (liver). It is not known that the expression of the gene is associated with cancer.

TEG3 (SEQ ID NO: 4) encodes EST (EPST1 isoform). The GenBank accession number of the gene is BE645480. It was found that the expression of the gene is elevated in stomach cancer, moderately differentiated liver cancer, large bowel cancer, lung cancer, pancreatic cancer and metastatic tissue of large bowel cancer (liver) It is not known that the expression of the gene is associated with cancer.

TEG4 (SEQ ID NO: 5) encodes EST. The GenBank accession number of the gene is AA447317. It was found that the expression of the gene is elevated in stomach cancer, large bowel cancer and metastatic tissue of large bowel cancer (liver). It is not known that the expression of the gene is associated with cancer.

TEG5 (SEQ ID NO: 6) encodes EST. The GenBank accession number of the gene is AI217375. It was found that the expression of the gene is elevated in stomach cancer and pancreatic cancer. It is not known that the expression of the gene is associated with cancer.

TEG6 (SEQ ID NO: 7; SEQ ID NO: 68) encodes OK/SW-CL30. The GenBank accession number of the gene is AI217375. It was found that the expression of the gene is elevated in lung cancer, stomach cancer, large bowel cancer and moderately differentiated liver cancer. It is not known that the expression of the gene is associated with cancer.

TEG7 (SEQ ID NO: 8) encodes DKFZp686L1533. The GenBank accession number of the gene is BG492359. It was found that the expression of the gene is elevated in lung cancer, stomach cancer, large bowel cancer, moderately or poorly differentiated liver cancer and metastatic tissue of large bowel cancer (liver). It is not known that the expression of the gene is associated with cancer.

TEG8 (SEQ. ID NO: 10; SEQ ID NO: 69) encodes EST (Gene #30). The protein encoded by the gene is a membrane protein. The GenBank accession number of the gene is BF825703. It was found that the expression of the gene is elevated in stomach cancer, poorly differentiated liver cancer and lung cancer. It is not known that the expression of the gene is associated with cancer.

TEG9 (SEQ ID NO: 11; SEQ ID NO: 70) encodes BC012317. The GenBank accession number of the gene is AL389981.1. It was found that the expression of the gene is elevated in stomach cancer, poorly differentiated liver cancer, pancreatic cancer and metastatic tissue of large bowel cancer (liver). It is not known that the expression of the gene is associated with cancer.

TEG10 (SEQ ID NO: 12) encodes EST242881. The GenBank accession number of the gene is BG285837. It was found that the expression of the gene is elevated in stomach cancer, moderately or poorly differentiated liver cancer and lung cancer. It is not known that the expression of the gene is associated with cancer.

TEG11 (SEQ ID NO: 13; SEQ ID NO: 71) encodes FLJ11041. The GenBank accession number of the gene is AI343467. It was found that the expression of the gene is elevated in stomach cancer, large bowel cancer, moderately differentiated liver cancer, lung cancer, pancreatic cancer and metastatic tissue of large bowel cancer (liver). It is not known that the expression of the gene is associated with cancer.

TEG12 (SEQ ID NO: 15; SEQ ID NO: 72) encodes EST. The GenBank accession number of the gene is BF057073. As described in the following Examples, the full-length sequence of the gene was determined in the present invention. It was found that the expression of the gene is elevated in liver cancer. It is not known that the expression of the gene is associated with cancer.

TEG13 (SEQ ID NO: 16) encodes EST. The GenBank accession number of the gene is H66658. It was found that the expression of the gene is elevated in liver cancer. It is not known that the expression of the gene is associated with cancer.

TEG14 (SEQ ID NO: 17; SEQ ID NO: 73) encodes ASPM. The GenBank accession number of the gene is NM_018123.1. It was found that the expression of the gene is elevated in stomach cancer, large bowel cancer, liver cancer and lung cancer. It is not known that the expression of the gene is associated with cancer.

TEG15 (SEQ ID NO: 18; SEQ ID NO: 74) encodes Sp5. The GenBank accession number of the gene is AI380207. It was found that the expression of the gene is elevated in stomach cancer, large bowel cancer, liver cancer and lung cancer. It is not known that the expression of the gene is associated with cancer.

TEG16 (SEQ ID NO: 19) encodes IMAGE: 297403. The GenBank accession number of the gene is AF339813.1. It was found that the expression of the gene is elevated in liver cancer, lung cancer, pancreatic cancer and metastatic tissue of large bowel cancer (liver) It is not known that the expression of the gene is associated with cancer.

TEG17 (SEQ ID NO: 20; SEQ ID NO: 75) encodes DKFZp434k2435. The protein encoded by the gene is a membrane protein. The GenBank accession number of the gene is AL136855.1 (reference sequence ID: NM_032256). It was found that the expression of the gene is elevated in stomach cancer, large bowel cancer, lung cancer and pancreatic cancer. It is not known that the expression of the gene is associated with cancer.

TEG18 (SEQ ID NO: 22; SEQ ID NO: 76) encodes CBRC7TM_249. The protein encoded by the gene is a membrane protein. The GenBank accession number of the gene is AI694413. It was found that the expression of the gene is elevated in stomach cancer, large bowel cancer, moderately or poorly differentiated liver cancer, pancreatic cancer and metastatic tissue of large bowel cancer (liver). It is not known that the expression of the gene is associated with cancer.

TEG19 (SEQ ID NO: 1; SEQ ID NO: 77) encodes VLGR1. The protein encoded by the gene is a membrane protein. The GenBank accession number of the gene is AF055084.1 (reference sequence ID: NM_032119). It was found that the expression of the gene is elevated in lung cancer and pancreatic cancer. It is not known that the expression of the gene is associated with cancer.

TEG20 (SEQ ID NO: 9; SEQ ID NO: 78) encodes C20orf54. The protein encoded by the gene is a membrane protein. The GenBank accession number of the gene is AA903862 (reference sequence ID: NM_033409). It was found that the expression of the gene is elevated in stomach cancer, large bowel cancer, lung cancer and metastatic tissue of large bowel cancer (liver). It is not known that the expression of the gene is associated with cancer.

TEG21 (SEQ ID NO: 14; SEQ ID NO: 79) encodes RHBG. The protein encoded by the gene is a membrane protein. The GenBank accession number of the gene is NM_020407.1 (reference sequence ID: NM_020407). It was found that the expression of the gene is elevated in liver cancer. It is not known that the expression of the gene is associated with cancer.

TEG22 (SEQ ID NO: 21; SEQ ID NO: 80) encodes COPG2. The GenBank accession number of the gene is AB047847.1 (reference sequence ID: NM_012133). It was found that the expression of the gene is elevated in large bowel cancer and lung cancer. It is not known that the expression of the gene is associated with cancer.

TEG23 (SEQ ID NOs: 64 and 65; SEQ ID NOs: 81 and 82) encodes EST. The GenBank accession number of the gene is AL039884. As described in the following Examples, the full-length sequence of this gene was determined in the present invention. It was found that the expression of the gene is elevated in poorly differentiated liver cancer and lung cancer. It is not known that the expression of the gene is associated with cancer.

TEG24 (SEQ ID NO: 23; SEQ ID NO: 83) encodes BE670584. The GenBank accession number of the gene is BE670584. It was found that the expression of the gene is elevated in stomach cancer, lung cancer and metastatic tissue of large bowel cancer (liver). It is not known that the expression of the gene is associated with cancer TEG25 (SEQ ID NO: 24; SEQ ID NO: 84) encodes GRP49. The protein encoded by the gene is a membrane protein. The GenBank accession number of the gene is AL524520 (reference sequence ID: NM_003667). It was found that the expression of the gene is elevated in stomach cancer, large bowel cancer, moderately differentiated liver cancer, lung cancer and metastatic tissue of large bowel cancer (liver). It is not known that the expression of the gene is associated with cancer.

TEG26 (SEQ ID NO: 25; SEQ ID NO: 85) encodes MUC17. The protein encoded by the gene is a membrane protein. The GenBank accession number of the gene is AK026404.1. It was found that the expression of the gene is elevated in stomach cancer and pancreatic cancer. It is not known that the expression of the gene is associated with stomach cancer.

TEG27 (SEQ ID NO: 26; SEQ ID NO: 86) encodes EPHB2. The protein encoded by the gene is a membrane protein. The GenBank accession number of the gene is AF025304.1 (reference sequence ID: NM_004442). It was found that the expression of the gene is elevated in stomach cancer, large bowel cancer, lung cancer and metastatic tissue of large bowel cancer (liver). It is not known that the expression of the gene is associated with large bowel cancer.

TEG28 (SEQ ID NO: 27; SEQ ID NO: 87) encodes GPCR41 (FLJ11856). The protein encoded by the gene is a membrane protein. The GenBank accession number of the gene is AK021918.1 (reference sequence ID: NM_024531). It was found that the expression of the gene is elevated in stomach cancer, large bowel cancer, lung cancer, metastatic tissue of large bowel cancer (liver) and pancreatic cancer. It is not known that the expression of the gene is associated with stomach cancer.

TEG29 (SEQ ID NO: 28; SEQ ID NO: 88) encodes HS6ST2. The protein encoded by the gene is a membrane protein. The GenBank accession number of the gene is AI767756. It was found that the expression of the gene is elevated in lung cancer, large bowel cancer, poorly differentiated liver cancer and pancreatic cancer. It is not known that the expression of the gene is associated with lung cancer.

TEG30 (SEQ ID NO: 29; SEQ ID NO: 89) encodes PCDHB2. The protein encoded by the gene is a membrane protein. The GenBank accession number of the gene is NM_018936.1 (reference sequence ID: NM_018936). It was found that the expression of the gene is elevated in lung cancer and pancreatic cancer. It is not known that the expression of the gene is associated with lung cancer.

TEG31 (SEQ ID NO: 30; SEQ ID NO: 90) encodes WFDC3 (C20orf167). The GenBank accession number of the gene is AL050348. It was found that the expression of the gene is elevated in lung cancer and pancreatic cancer. It is not known that the expression of the gene is associated with lung cancer.

TEG32 (SEQ ID NO: 31; SEQ ID NO: 91) encodes C20orf42. The GenBank accession number of the gene is NM_017671.1 (reference sequence ID: NM_017671). It was found that the expression of the gene is elevated in lung cancer, stomach cancer, large bowel cancer and metastatic tissue of large bowel cancer (liver). It is not known that the expression of the gene is associated with lung cancer.

TEG33 (SEQ ID NO: 32; SEQ ID NO: 92) encodes PIGR. The protein encoded by the gene is a membrane protein. The GenBank accession number of the gene is NM_002644.1 (reference sequence ID: NM_002644). It was found that the expression of the gene is elevated in lung cancer and large bowel cancer. It is not known that the expression of the gene is associated with lung cancer.

TEG34 (SEQ ID NO: 33; SEQ ID NO: 93) encodes 2FE2L3. The GenBank accession number of the gene is NM_004289.3 (reference sequence ID: NM_004289). It was found that the expression of the gene is elevated in stomach cancer, large bowel cancer, lung cancer, metastatic tissue of large bowel cancer (liver) and pancreatic cancer. It is not known that the expression of the gene is associated with stomach cancer.

TEG35 (SEQ ID NO: 34; SEQ ID NO: 94) encodes TRAG3. The GenBank accession number of the gene is NM_004909.1 (reference sequence ID: NM_004909). It was found that the expression of the gene is elevated in stomach cancer, lung cancer and pancreatic cancer. It is not known that the expression of the gene is associated with stomach cancer.

TEG36 (SEQ ID NO: 35; SEQ ID NO: 95) encodes TRIM31. The GenBank accession number of the gene is NM_007028. It was found that the expression of the gene is elevated in stomach cancer, pancreatic cancer and lung cancer. It is not known that the expression of the gene is associated with stomach cancer.

TEG37 (SEQ ID NO: 36; SEQ ID NO: 96) encodes KIAA1359. The GenBank accession number of the gene is AB037780. It was found that the expression of the gene is elevated in stomach cancer, lung cancer, large bowel cancer, pancreatic cancer and metastatic tissue of large bowel cancer (liver). It is not known that the expression of the gene is associated with stomach cancer.

TEG38 (SEQ ID NO: 37; SEQ ID NO: 97) encodes ubiquitin D. The GenBank accession number of the gene is NM_006398. It was found that the expression of the gene is elevated in stomach cancer, large bowel cancer, lung cancer, moderately or poorly differentiated liver cancer, lung cancer and pancreatic cancer. It is not known that the expression of the gene is associated with stomach cancer.

TEG39 (SEQ ID NO: 38; SEQ ID NO: 98) encodes Hephaestin. The protein encoded by the gene is a membrane protein. The GenBank accession number of the gene is NM_014799.1 (reference sequence ID: NM_014799). It was found that the expression of the gene is elevated in stomach cancer, metastatic tissue of large bowel cancer (liver) and pancreatic cancer. It is not known that the expression of the gene is associated with stomach cancer.

TEG40 (SEQ ID NO: 39; SEQ ID NO: 99) encodes KIAA0152. The protein encoded by the gene is a membrane protein. The GenBank accession number of the gene is BC000371.1 (reference sequence ID: NM_014730). It was found that the expression of the gene is elevated in stomach cancer, large bowel cancer, glioblastoma and lung cancer. It is not known that the expression of the gene is associated with stomach cancer.

TEG41 (SEQ ID NO: 40; SEQ ID NO: 100) encodes KIAA0703. The protein encoded by the gene is a membrane protein. The GenBank accession number of the gene is NM_014861.1 (reference sequence ID: NM_014861). It was found that the expression of the gene is elevated in stomach cancer, lung cancer and metastatic tissue of large bowel cancer (liver). It is not known that the expression of the gene is associated with stomach cancer.

TEG42 (SEQ ID NO: 41; SEQ ID NO: 101) encodes MEST/PEG1. The GenBank accession number of the gene is NM_002402.1 (reference sequence ID: NM_002402). It was found that the expression of the gene is elevated in stomach cancer, large bowel cancer and lung cancer. It is not known that the expression of the gene is associated with stomach cancer.

TEG43 (SEQ ID NO: 42; SEQ ID NO: 102) encodes KIAA1199. The GenBank accession number of the gene is AB033025.1. It was found that the expression of the gene is elevated in stomach cancer, lung cancer, large bowel cancer and pancreatic cancer. It is not known that the expression of the gene is associated with stomach cancer.

TEG44 (SEQ ID NO: 43; SEQ ID NO: 103) encodes ELOVL2. The GenBank accession number of the gene is BF508639 (reference sequence ID: NM_017770). It was found that the expression of the gene is elevated in liver cancer, glioblastoma and lung cancer.

TEG45 (SEQ ID NO: 44; SEQ ID NO: 104) encodes ROBO1. The protein encoded by the gene is a membrane protein. The GenBank accession number of the gene is BF059159 (reference sequence ID: NM_133631). It was found that the expression of the gene is elevated in liver cancer, glioblastoma and lung cancer.

TEG46 (SEQ ID NO: 45; SEQ ID NO: 105) encodes FLJ10504 MISATO. The GenBank accession number of the gene is BC002535.1 (reference sequence ID: NM_018116). It was found that the expression of the gene is elevated in liver cancer, lung cancer and pancreatic cancer. It is not known that the expression of the gene is associated with liver cancer.

TEG47 (SEQ ID NO: 46; SEQ ID NO: 106) encodes cystatin SN. The GenBank accession number of the gene is NM_001898.1 (reference sequence ID: NM_001898). It was found that the expression of the gene is elevated in large bowel cancer and lung cancer. It is not known that the expression of the gene is associated with large bowel cancer.

TEG48 (SEQ ID NO: 47; SEQ ID NO: 107) encodes LOC116238. The GenBank accession number of the gene is BE328850 (reference sequence ID: NM_138463). It was found that the expression of the gene is elevated in stomach cancer, large bowel cancer, lung cancer, poorly differentiated liver cancer and pancreatic cancer.

TEG49 (SEQ ID NO: 48; SEQ ID NO: 108) encodes MRPL50. The GenBank accession number of the gene is BG028213 (reference sequence ID: NM_019051). It was found that the expression of the gene is elevated in stomach cancer, large bowel cancer, moderately or poorly differentiated liver cancer, glioblastoma, lung cancer and pancreatic cancer.

TEG50 (SEQ ID NO: 49; SEQ ID NO: 109) encodes TOP1mt. The GenBank accession number of the gene is AW592604 (reference sequence ID: NM_052963). It was found that the expression of the gene is elevated in large bowel cancer, poorly differentiated liver cancer, metastatic tissue of large bowel cancer (liver) and pancreatic cancer. It is not known that the expression of the gene is associated with large bowel cancer.

TEG51 (SEQ ID NO: 50; SEQ ID NO: 110) encodes FKSG14. The GenBank accession number of the gene is BC005400.1 (reference sequence ID: NM_022145). It was found that the expression of the gene is elevated in stomach cancer, large bowel cancer, lung cancer and pancreatic cancer. It is not known that the expression of the gene is associated with large bowel cancer.

TEG52 (SEQ ID NO: 51; SEQ ID NO: 111) encodes CDH3. The protein encoded by the gene is a membrane protein. The GenBank accession number of the gene is NM_001793.1 (reference sequence ID: NM_001793). It was found that the expression of the gene is elevated in lung cancer, stomach cancer, large bowel cancer and pancreatic cancer.

TEG53 (SEQ ID NO: 52; SEQ ID NO: 112) encodes NRP2. The protein encoded by the gene is a membrane protein. The GenBank accession number of the gene is N90777 (reference sequence ID: NM_003872). It was found that the expression of the gene is elevated in lung cancer, glioblastoma, metastatic tissue of large bowel cancer (liver) and pancreatic cancer.

TEG54 (SEQ ID NO: 53; SEQ ID NO: 113) encodes CLDN3. The protein encoded by the gene is a membrane protein. The GenBank accession number of the gene is BE791251 (reference sequence ID: NM_001306). It was found that the expression of the gene is elevated in stomach cancer, lung cancer, large bowel cancer and metastatic tissue of large bowel cancer (liver). It is not known that the expression of the gene is associated with stomach cancer.

TEG55 (SEQ ID NO: 54; SEQ ID NO: 114) encodes CLDN4. The protein encoded by the gene is a membrane protein. The GenBank accession number of the gene is NM_001305.1 (reference sequence ID: NM_001305). It was found that the expression of the gene is elevated in stomach cancer, lung cancer, large bowel cancer, metastatic tissue of large bowel cancer (liver) and pancreatic cancer. It is not known that the expression of the gene is associated with stomach cancer.

TEG56 (SEQ ID NO: 55; SEQ ID NO: 115) encodes sfrp4. The GenBank accession number of the gene is AW089415 (reference sequence ID: NM_003014). It was found that the expression of the gene is elevated in lung cancer, stomach cancer, glioblastoma and pancreatic cancer. It is not known that the expression of the gene is associated with stomach cancer.

TEG57 (SEQ ID NO: 56; SEQ ID NO: 116) encodes ASP-SCR1. The GenBank accession number of the gene is NM_024083.1 (reference sequence ID: NM_024083). It was found that the expression of the gene is elevated in liver cancer and lung cancer. It is not known, that the expression of the gene is associated with liver cancer.

TEG58 (SEQ ID NO: 57; SEQ ID NO: 117) encodes GAGEC1. The GenBank accession number of the gene is NM_007003.1 (reference sequence ID: NM_007003). It was found that the expression of the gene is elevated in liver cancer. It is not known that the expression of the gene is associated with liver cancer.

TEG59 (SEQ ID NO: 58; SEQ ID NO: 118) encodes RHAMM. The protein encoded by the gene is a membrane protein. The GenBank accession number of the gene is NM_012485.1 (reference sequence ID: NM_012484). It was found that the expression of the gene is elevated in stomach cancer, large bowel cancer, liver cancer and pancreatic cancer. It is not known that the expression of the gene is associated with liver cancer.

TEG60 (SEQ ID NO: 59; SEQ ID NO: 119) encodes PEG10. The GenBank accession number of the gene is BE858180 (reference sequence ID: NM_015068). It was found that the expression of the gene is elevated in liver cancer, lung cancer and hepatoblastoma.

TEG61 (SEQ ID NO: 60; SEQ ID NO: 120) encodes PAEP. The GenBank accession number of the gene is NM_002571.1 (reference sequence ID: NM_002571). It was found that the expression of the gene is elevated in lung cancer and pancreatic cancer.

TEG62 (SEQ ID NO: 61; SEQ ID NO: 121) encodes MGC10981. The GenBank accession number of the gene is BC004397.1 (reference sequence ID: NM_032654). It was found that the expression of the gene is elevated in lung cancer and pancreatic cancer.

TEG63 (SEQ ID NO: 62; SEQ ID NO: 122) encodes DUSP9. The GenBank accession number of the gene is NM_001395.1 (reference sequence ID: NM_001395). It was found that the expression of the gene is elevated in liver cancer.

TEG64 (SEQ ID NO: 63; SEQ ID NO: 123) encodes KIAA1089. The GenBank accession number of the gene is AB029012.1. It was found that the expression of the gene is elevated in liver cancer, lung cancer and pancreatic cancer.

The entire contents of all patents and references expressly cited in the present specification are incorporated herein by reference. In addition, the entire contents described in the specification and drawings of Japanese Patent Application No. 2003-290704 to which this application claims priority are also incorporated herein by reference.

EXAMPLES

Hereinafter, the present invention will be described in more detail with reference to Examples, however, these Examples are not to be construed to limit the scope of the invention.

Example 1

Identification of Gene Whose Expression is Elevated in Human Cancer Tissue

In order to identify a gene whose expression is elevated in each type of human cancer tissue (lung adenocarcinoma, stomach cancer, large bowel cancer, hepatocellular carcinoma and brain tumor) compared with that in normal tissue, an expression analysis of mRNA was carried out in each type of excised human cancer tissue using GeneChip (GeneChip™ HG-133A, B Target; manufactured by Affymetryx).

1.1. Identification of Gene Whose Expression is Elevated in Human Lung Adenocarcinoma In order to identify a gene whose expression is elevated in human lung adenocarcinoma compared with that in normal human lung tissue, an expression analysis of mRNA was carried out as follows.

First, total RNA was prepared from the cancerous part of 12 cases of excised lung adenocarcinoma tissue including different differentiation degrees and stages, and one case of normal lung using ISOGEN (Nippon Gene) according to the attached method. Then, mRNA expression in the lung adenocarcinoma and normal lung was analyzed using a GeneChip™ HG-U133A, B (manufactured by Affymetryx). More specifically, 5 μg of a material obtained by mixing the respective total RNA prepared from the 12 cases in an equal amount as for the cancerous part, or 5 μg of the total RNA prepared from the one case of normal lung as a control was analyzed for gene expression according to Expression Analysis Technical Manual (Affymetryx). The mean value of expression scores of all genes in each analysis was defined as 100 and the expression level of each gene was indicated as a relative value.

1.2. Identification of Gene Whose Expression is Elevated in Human Stomach Cancer In order to identify a gene whose expression is elevated in human stomach cancer compared with that in normal human stomach tissue, an expression analysis of mRNA was carried out in the same manner as described above.

Total RNA was prepared from 3 cases of excised stomach cancer tissue and one case of normal stomach in the same manner as described above. Five micrograms of a material obtained by mixing the respective total RNA prepared from the 3 cases in an equal amount as for the cancerous part, or 5 μg of the total RNA prepared from the one case of normal stomach as a control was analyzed for mRNA expression using a GeneChip™ HG-U133A, B (manufactured by Affymetryx). The mean value of expression scores of all genes in each analysis was defined as 100 and the expression level of each gene was indicated as a relative value.

1.3. Identification of Gene Whose Expression is Elevated in Human Large Bowel Cancer Identification of a gene whose expression is elevated in human large bowel cancer compared with that in normal human large bowel tissue was carried out in the same manner as described above.

Total RNA was prepared from the cancerous part of 3 cases of excised large bowel cancer tissue and one case of normal large bowel tissue in the same manner as described above. Five micrograms of a material obtained by mixing the respective total RNA prepared from the 3 cases in an equal amount as for the cancerous part, or 5 μg of the total RNA prepared from the one case of normal large bowel as a control was analyzed for mRNA expression using a GeneChip™ HG-U133A, B Target (manufactured by Affymetryx). The mean value of expression scores of all genes in each analysis was defined as 100 and the expression level of each gene was indicated as a relative value.

1.4. Identification of Gene Whose Expression is Elevated in Human Hepatocellular Carcinoma Identification of a gene whose expression is elevated in human hepatocellular carcinoma compared with that in normal human liver was carried out in the same manner as described above.

Total RNA was prepared from the cancerous part of 3 cases of hepatitis C virus infected moderately differentiated hepatocellular carcinoma, 3 cases of hepatitis C virus infected poorly differentiated hepatocellular carcinoma and one case of normal liver tissue in the same manner as described above. Five micrograms of a material obtained by mixing the respective total RNA prepared from the 3 cases in an equal amount as for each cancerous part of the different differentiation degrees, or 5 μg of the total RNA prepared from the one case of the normal liver as a control was analyzed for mRNA expression using a GeneChip™ HG-U133A, B (manufactured by Affymetryx). The mean value of expression scores of all genes in each analysis was defined as 100 and the expression level of each gene was indicated as a relative value.

1.5. Identification of Gene Whose Expression is Elevated in Human Glioblastoma Identification of a gene whose expression is elevated in human glioblastoma compared with that in normal human brain tissue was carried out in the same manner as described above.

Total RNA was prepared from the cancerous part of 5 cases of excised glioblastoma tissue and one case of normal brain tissue in the same manner as described above. Five micrograms of a material obtained by mixing the respective total RNA prepared from the 5 cases in an equal amount as for the cancerous part, or 5 μg of the total RNA prepared from the one case of the normal brain tissue as a control was analyzed for mRNA expression using a GeneChip™ HG-U133A, B (manufactured by Affymetryx). The mean value of expression scores of all genes in each analysis was defined as 100 and the expression level of each gene was indicated as a relative value.

From the results of the above analyses, it was found that mRNA expression of the genes shown in Table 2 is elevated compared with that in each of the corresponding normal tissue.

TABLE 2

| No. | Name | Cancer type in which expression is elevated | Gene chip analysis results | | | | |
|---|---|---|---|---|---|---|---|
| | | | Lung | Lung cancer | Stomach | Stomach cancer | Large bowel |
| TEG1 | C20orf102 | Lung cancer, Moderately differentiated liver cancer | 32 | 299.3 | 98.6 | 50.3 | 95.2 |
| TEG2 | ASCL2 | Stomach cancer, Large bowel cancer | 66.1 | 27.4 | 6 | 406.9 | 79.1 |
| TEG3 | EST | Stomach cancer, Moderately differentiated liver cancer | 65.1 | 74.6 | 92.1 | 440.8 | 112.9 |
| TEG4 | EST | Stomach cancer, Large bowel cancer | 50.9 | 25.1 | 41.4 | 117.2 | 52.5 |
| TEG5 | EST | Stomach cancer | 79.7 | 85 | 58.7 | 248.2 | 73.9 |
| TEG6 | OK/SW-CL . . . 30 | Lung cancer, Stomach cancer, Large bowel cancer, Moderately differentiated liver cancer | 84.1 | 118.9 | 55.6 | 537.1 | 98.5 |
| TEG7 | DKFZp686L1533 | Lung cancer, Stomach cancer, Large bowel cancer, Moderately or poorly differentiated liver cancer | 79.2 | 173.3 | 14.6 | 588.5 | 89.2 |
| TEG8 | EST | Stomach cancer, Poorly differentiated liver cancer | 59.1 | 50.8 | 37.5 | 260.7 | 36.3 |
| TEG9 | LOC93082 | Stomach cancer, Poorly differentiated liver cancer | 107.3 | 34.5 | 14.5 | 1030.1 | 89.2 |
| TEG10 | EST | Stomach cancer, Moderately or poorly differentiated liver cancer | 38.1 | 37.8 | 32.8 | 385.8 | 20.3 |
| TEG11 | FLJ11041 | Stomach cancer, Large bowel cancer, Moderately differentiated liver cancer | 607.1 | 481.8 | 16.9 | 261.5 | 19.2 |
| TEG12 | EST | Liver cancer | 60.8 | 65.2 | 91 | 38.6 | 44.5 |
| TEG13 | EST | Liver cancer | 38 | 10.3 | 35.5 | 17 | 16.3 |

TABLE 2-continued

| | | | | | | | |
|---|---|---|---|---|---|---|---|
| TEG14 | ASPM | Stomach cancer, Large bowel cancer, Liver cancer | 1.3 | 45.1 | 3.8 | 107.3 | 18.2 |
| TEG15 | Sp5 | Stomach cancer, Large bowel cancer, Liver cancer | 8 | 15.8 | 57.9 | 219.2 | 14.5 |
| TEG16 | IMAGE: 297403 | Liver cancer | 5.7 | 12.7 | 25 | 11.5 | 20.2 |
| TEG17 | DKFZp434K2435 | Stomach cancer, Large bowel cancer | 11.1 | 5.9 | 16.1 | 183.1 | 16.6 |
| TEG18 | CBRC7TM_249 | Stomach cancer, Large bowel cancer, Moderately or poorly differentiated liver cancer | 13.6 | 86.6 | 45 | 240.4 | 19.6 |
| TEG19 | MASS1/VLGR1 | Lung cancer | 23.6 | 254.4 | 17.1 | 5.3 | 18 |
| TEG20 | C20orf54 | Stomach cancer, Large bowel cancer, Liver cancer | 21.7 | 69.6 | 22.8 | 261.1 | 22.4 |
| TEG21 | RHBG | Liver cancer | 8.7 | 13.4 | 19.1 | 5.4 | 15.6 |
| TEG22 | COPG2 | Large bowel cancer | 77 | 66.9 | 83.1 | 47.5 | 21.7 |
| TEG23 | EST | Poorly differentiated liver cancer | 35.1 | 81.2 | 2 | 21.1 | 28 |
| TEG24 | EST | Stomach cancer | 28.9 | 19.4 | 35.6 | 197.1 | 44.8 |
| TEG25 | GPR49 | Stomach cancer, Large bowel cancer, Moderately differentiated liver cancer | 23.9 | 15.8 | 24.3 | 538.3 | 41.6 |
| TEG26 | MUC17 | Stomach cancer | 73.4 | 59.1 | 89.4 | 565.2 | 113.3 |
| TEG27 | EphB2 | Stomach cancer, Large bowel cancer | 23.2 | 47.5 | 6.8 | 218.7 | 62.8 |
| TEG28 | FLJ11856/GPCR41 | Stomach cancer, Large bowel cancer | 22.2 | 35.2 | 9.1 | 229.5 | 63.8 |
| TEG29 | HS6ST2 | Stomach cancer, Large bowel cancer, Poorly differentiated liver cancer | 20.8 | 472.6 | 3.6 | 2.3 | 37.2 |
| TEG30 | PCDHB2 | Lung cancer | 11.9 | 228.5 | 55.2 | 37.7 | 32.2 |
| TEG31 | WFDC3 | Lung cancer | 30.1 | 304.2 | 110.6 | 28.7 | 32.2 |
| TEG32 | C20orf42 | Lung cancer, Stomach cancer, Large bowel cancer | 11.6 | 43.8 | 127.7 | 365.4 | 175.8 |
| TEG33 | PIGR | Lung cancer | 63.2 | 382.6 | 129.9 | 149.3 | 520.1 |
| TEG34 | NFE2L3 | Stomach cancer, Large bowel cancer | 37 | 62.4 | 55.2 | 144.9 | 22 |
| TEG35 | TRAG3 | Stomach cancer | 1.8 | 1.7 | 1.9 | 74.4 | 1.2 |
| TEG36 | TRIM31 | Stomach cancer | 16.9 | 13.2 | 14.6 | 155.2 | 67.3 |
| TEG37 | KIAA1359 | Stomach cancer, Lung cancer, Large bowel cancer | 22.8 | 190.3 | 7.5 | 521.1 | 196.8 |
| TEG38 | ubiquitinD | Stomach cancer, Large bowel cancer, Lung cancer, Moderately or poorly differentiated liver cancer | 89.7 | 311.5 | 44.2 | 1172.8 | 60.1 |
| TEG39 | Hephaestin | Stomach cancer | 97.6 | 97.3 | 75.8 | 341.5 | 568.8 |
| TEG40 | KIAA0152 | Stomach cancer, Large bowel cancer, Glioblastoma | 32.5 | 82.1 | 36.2 | 214.9 | 58.2 |
| TEG41 | KIAA0703 | Stomach cancer | 84.6 | 46.3 | 20.1 | 214.3 | 195.3 |
| TEG42 | MEST/PEG1 | Stomach cancer, Large bowel cancer | 235.9 | 406.2 | 92.6 | 524.3 | 178.4 |
| TEG43 | KIAA1199 | Stomach cancer, Lung cancer, Large bowel cancer | 53.6 | 162.4 | 26.2 | 80.7 | 28.9 |
| TEG44 | ELOVL2 | Liver cancer, Glioblastoma | 10.1 | 0.8 | 2.8 | 3 | 15.5 |
| TEG45 | ROBO1 | Liver cancer, Glioblastoma | 58.5 | 49.1 | 32.4 | 38 | 21.4 |
| TEG46 | FLJ10504/misato | Liver cancer | 53.8 | 38.8 | 6.5 | 49.5 | 5.6 |
| TEG47 | cystatin SN | Large bowel cancer | 2.7 | 53.6 | 4.4 | 98.1 | 9.4 |
| TEG48 | LOC116238 | Stomach cancer, Large bowel cancer, Lung cancer, Poorly differentiated liver cancer | 6.9 | 159.3 | 45.6 | 122.8 | 10.1 |
| TEG49 | MRPL50 | Stomach cancer, Large bowel cancer, Moderately or poorly differentiated liver cancer, Glioblastoma | 77.8 | 86.1 | 98.1 | 191.2 | 43.8 |
| TEG50 | TOP1MT | Large bowel cancer, Poorly differentiated liver cancer | 16.5 | 30.8 | 19.1 | 49.7 | 31.3 |
| TEG51 | FKSG14 | Stomach cancer, Large bowel cancer | 23.1 | 38.1 | 11.1 | 114.8 | 32.2 |
| TEG52 | CDH3 | Lung cancer, Stomach cancer, Large bowel cancer | 24.1 | 172.5 | 5.8 | 64.5 | 5.4 |
| TEG53 | NRP2 | Lung cancer | 26.4 | 171.1 | 40.4 | 25.8 | 88 |
| TEG54 | CLDN3 | Stomach cancer, Lung cancer | 3.2 | 147.6 | 0.8 | 624.4 | 1206.9 |
| TEG55 | CLDN4 | Stomach cancer, Lung cancer | 70.1 | 193.6 | 3.9 | 364.8 | 258.4 |
| TEG56 | SFRP4 | Lung cancer, Stomach cancer, Glioblastoma | 153.6 | 244.9 | 66.9 | 153.1 | 69.4 |
| TEG57 | ASPSCR1 | Liver cancer | 42.4 | 45.4 | 41.5 | 75.1 | 28.4 |
| TEG58 | GAGEC1 | Liver cancer | 6.1 | 17.9 | 31.7 | 4.2 | 4.8 |
| TEG59 | RHAMM | Stomach cancer, Large bowel cancer, Liver cancer | 19.6 | 46.1 | 35.6 | 115.3 | 36.2 |

TABLE 2-continued

| | | | | | | | |
|---|---|---|---|---|---|---|---|
| TEG60 | PEG10 | Liver cancer, Lung cancer, Hepatoblastoma | 42.9 | 216.9 | 45.7 | 21.4 | 28.6 |
| TEG61 | PAEP | Lung cancer | 4.1 | 96.4 | 9.6 | 7.5 | 6.4 |
| TEG62 | MGC10981 | Lung cancer | 58.1 | 459 | 59.7 | 44.9 | 91 |
| TEG63 | DUSP9 | Liver cancer | 20 | 33.7 | 25.9 | 28.9 | 30.9 |
| TEG64 | EST1B | Liver cancer | 52.6 | 18.7 | 20.8 | 34.9 | 24.3 |

| | Gene chip analysis results | | | | | |
|---|---|---|---|---|---|---|
| No. | Large bowel cancer | Liver | Moderately differentiated liver cancer | Poorly differentiated liver cancer | Brain | Glioblastoma |
| TEG1 | 18.4 | 39.1 | 104.9 | 13 | 834.4 | 90.8 |
| TEG2 | 738.8 | 19.5 | 5.9 | 31.2 | 3.6 | 10.7 |
| TEG3 | 107.6 | 142.3 | 216 | 164.4 | 53.2 | 86.9 |
| TEG4 | 106.8 | 12 | 38.5 | 12.5 | 31.2 | 61.1 |
| TEG5 | 63.5 | 11.3 | 59.7 | 96.9 | 44 | 87.2 |
| TEG6 | 734.1 | 157.7 | 1781.4 | 160.8 | 78.7 | 106 |
| TEG7 | 750.3 | 22.7 | 158 | 309.6 | 15.5 | 87.1 |
| TEG8 | 22.7 | 58.7 | 26.8 | 120 | 68.7 | 17.4 |
| TEG9 | 21.9 | 130 | 155.6 | 448.1 | 18.5 | 105.4 |
| TEG10 | 20.5 | 28.2 | 103.9 | 356.5 | 60.2 | 63.5 |
| TEG11 | 522.1 | 97.9 | 128.1 | 56.2 | 43.2 | 49.2 |
| TEG12 | 62.2 | 16.2 | 194.3 | 527 | 66.2 | 47.7 |
| TEG13 | 4.6 | 26.1 | 493.7 | 177.7 | 4.6 | 14.7 |
| TEG14 | 99.6 | 3.6 | 111.3 | 246.1 | 1.5 | 83.8 |
| TEG15 | 270.1 | 11.2 | 288.7 | 219.2 | 12 | 6.8 |
| TEG16 | 17.8 | 34.4 | 273.1 | 159.7 | 16.2 | 66.8 |
| TEG17 | 98.1 | 8.4 | 17.3 | 9.5 | 14.5 | 18.8 |
| TEG18 | 175.4 | 158.8 | 669 | 949 | 13.5 | 47.9 |
| TEG19 | 4.3 | 133.6 | 77.4 | 21.2 | 21.8 | 111.8 |
| TEG20 | 50.5 | 8.4 | 8.2 | 24.4 | 6.6 | 15.5 |
| TEG21 | 8.6 | 17.4 | 792.6 | 57.1 | 15.5 | 9.3 |
| TEG22 | 178.4 | 52.8 | 8.7 | 22.6 | 40.9 | 78.7 |
| TEG23 | 15.9 | 9.3 | 33.7 | 539.9 | 22.9 | 42.2 |
| TEG24 | 80.1 | 5.2 | 15.5 | 31.1 | 57.6 | 58.8 |
| TEG25 | 135.3 | 16.7 | 233.8 | 78.8 | 33.5 | 11.2 |
| TEG26 | 102.8 | 34.7 | 67.6 | 113.8 | 100 | 56.3 |
| TEG27 | 189.4 | 6.6 | 55.1 | 13.6 | 28.7 | 49 |
| TEG28 | 197.5 | 2.7 | 5.1 | 67.3 | 4.4 | 78.3 |
| TEG29 | 164.9 | 4.5 | 6.5 | 191.4 | 104 | 69 |
| TEG30 | 58.9 | 14.4 | 13.4 | 27.7 | 80.4 | 78 |
| TEG31 | 27.8 | 46.4 | 29.9 | 30.4 | 28.7 | 28.9 |
| TEG32 | 535.2 | 7 | 17.3 | 44 | 23.5 | 15.4 |
| TEG33 | 423.7 | 102.3 | 101.8 | 96 | 65.2 | 77.7 |
| TEG34 | 216.8 | 27.4 | 18.6 | 37.3 | 13.7 | 27.8 |
| TEG35 | 1.3 | 1.7 | 1.6 | 1.4 | 1.4 | 1.9 |
| TEG36 | 52.7 | 21 | 41.4 | 31 | 4.6 | 26.8 |
| TEG37 | 196.7 | 37.9 | 5.7 | 9.1 | 3.5 | 40.6 |
| TEG38 | 605.7 | 269.2 | 1460.9 | 2542.8 | 42.1 | 69 |
| TEG39 | 419.1 | 34.6 | 50.6 | 27 | 126.1 | 91.6 |
| TEG40 | 233.5 | 25.1 | 45.8 | 94 | 22.6 | 109.4 |
| TEG41 | 77.4 | 13.1 | 3.5 | 4.7 | 24.9 | 5.9 |
| TEG42 | 640.8 | 423 | 248.4 | 455.9 | 207.2 | 771.4 |
| TEG43 | 185 | 68.5 | 63.5 | 44.3 | 89.1 | 69.4 |
| TEG44 | 1.9 | 68.8 | 224.9 | 233.5 | 76.5 | 121.2 |
| TEG45 | 123.2 | 9.1 | 236.1 | 563 | 64.3 | 152.3 |
| TEG46 | 21.5 | 5.1 | 105.2 | 106.8 | 27.4 | 41.6 |
| TEG47 | 804.5 | 6.1 | 27.6 | 24.1 | 15.5 | 2.3 |
| TEG48 | 136.9 | 43.3 | 63.2 | 220.2 | 80 | 60.5 |
| TEG49 | 256.5 | 72 | 155.3 | 200.8 | 47.7 | 100 |
| TEG50 | 206.4 | 24.9 | 31.9 | 306.2 | 25.5 | 19 |
| TEG51 | 165 | 14 | 37.8 | 31.9 | 2.6 | 82.6 |
| TEG52 | 131.3 | 4.1 | 3.7 | 2.3 | 14.1 | 5.9 |
| TEG53 | 79.1 | 89.9 | 19.1 | 43.6 | 22.4 | 155.2 |
| TEG54 | 738.3 | 40.2 | 42.3 | 4.1 | 1.8 | 0.6 |
| TEG55 | 325.8 | 7.1 | 37.4 | 45.4 | 3.3 | 2.5 |
| TEG56 | 87.8 | 51.1 | 49.2 | 49.3 | 53.4 | 250.3 |
| TEG57 | 102.3 | 58.3 | 285.1 | 78.3 | 46.1 | 44.5 |
| TEG58 | 11.6 | 5.8 | 2014.7 | 45.9 | 8.2 | 12.1 |
| TEG59 | 158.6 | 10.6 | 103.2 | 84.5 | 7.4 | 55.4 |
| TEG60 | 36.7 | 40.6 | 389.8 | 174.7 | 80.9 | 64.5 |
| TEG61 | 5.5 | 4.4 | 6.2 | 6 | 6.5 | 4.4 |
| TEG62 | 71.6 | 98.6 | 87.7 | 8.1 | 56.8 | 34 |
| TEG63 | 24 | 46.4 | 212.7 | 687 | 49.4 | 24.1 |
| TEG64 | 25.5 | 16 | 82 | 83.2 | 24.2 | 42.3 |

In particular, as for TEG1 to TEG18, an elevation in their expression in any type of cancer cells had not been found so far and it was shown in this study that their expression is elevated in a certain type of cancer. In addition, as for each gene of TEG19 to TEG60, it was now found that their expression is elevated in another type of cancer other than those reported before.

1.6. Identification of Gene Whose Expression is Elevated in Each Type of Cancer Tissue The expression analysis of each gene of TEG1 to TEG64 in each type of cancer was carried out using a GeneChip™ HG-U133A, B (manufactured by Affymetryx) and a GeneChip™ HG-U133 plus 2 (manufactured by Affymetryx). More specifically, total RNA was prepared in the same manner as described above for each of the specimens from 10 cases of lung small cell lung cancer, 5 cases of lung squamous cell carcinoma, 5 cases of lung adenocarcinoma, 7 cases of large bowel cancer, 8 cases of metastatic tissue in liver from large bowel cancer, 2 cases of renal cancer and 4 cases of pancreatic cancer. Then, 5 μg of the total RNA was analyzed for mRNA expression with a GeneChip HG-U133A, B. The lung small cell cancer, large bowel cancer and Some samples from metastatic tissue in liver from large bowel cancer were analyzed only by a U-133A chip. The mean value of expression scores of all genes in each analysis was defined as 100 and the expression level of each gene was indicated as a relative value. In addition, samples from 22 cases of small cell cancer and 27 cases of pancreatic cancer were analyzed in the same manner using a GeneChip™ HG-U133 plus 2.

The results are shown in Tables 3 and 4. It was found that the expression of each gene of TEG1 to TEG 64 is elevated also in each type of cancer.

TABLE 3

| No | Lung small cell cancer 1 | Lung small cell cancer 2 | Lung small cell cancer 3 | Lung small cell cancer 4 | Lung small cell cancer 5 | Lung small cell cancer 6 | Lung small cell cancer 7 | Lung small cell cancer 8 | Lung small cell cancer 9 | Lung small cell cancer 10 |
|---|---|---|---|---|---|---|---|---|---|---|
| TEG1 | 11 | 12.3 | | 25.1 | | 20.8 | 15.6 | | 155.7 | |
| TEG2 | 159.8 | 71.9 | | 547.2 | | 671.4 | 162.3 | | 5.7 | |
| TEG3 | 109 | 93.3 | | 154.3 | | 203.3 | 114.4 | | 91.8 | |
| TEG4 | 29 | 40.8 | | 43.4 | | 17.6 | 44.5 | | 34.9 | |
| TEG5 | 36.4 | 64.8 | | 94.1 | | 95.9 | 81.8 | | 18.2 | |
| TEG6 | 34.6 | 130.1 | | 136.4 | | 28.8 | 94.3 | | 90.5 | |
| TEG7 | 540.3 | 739.3 | | 419.7 | | 387.9 | 311.1 | | 358.6 | |
| TEG8 | 8.8 | 15.3 | | 15.1 | | 31.8 | 14.9 | | 25.8 | |
| TEG9 | 65.6 | 37.4 | | 81.1 | | 36 | 82.3 | | 19.7 | |
| TEG10 | 163.2 | 181.1 | | 41.9 | | 370.1 | 11.1 | | 20.4 | |
| TEG11 | 175.2 | 199.5 | | 80.5 | | 299.3 | 92.3 | | 35.6 | |
| TEG12 | 54.4 | 75.4 | | 118.5 | | 63.2 | 85.1 | | 91.5 | |
| TEG13 | 3.7 | 23.5 | | 35.6 | | 53.2 | 11.6 | | 34.8 | |
| TEG14 | 329.4 | 134.1 | 127 | 17.1 | 86.9 | 41.3 | 120.2 | 57.4 | 165.9 | 3.4 |
| TEG15 | 8.9 | 15 | | 40 | | 9.9 | 94 | | 148.5 | |
| TEG16 | 11.9 | 143.3 | | 15 | | 13.9 | 59.3 | | 25.6 | |
| TEG17 | 101.7 | 5.6 | | 4.4 | | 6.1 | 4.6 | | 7.8 | |
| TEG18 | 82.7 | 111.9 | | 123.8 | | 126.9 | 129.5 | | 87.1 | |
| TEG19 | 6.9 | 94.2 | | 5.6 | | 11 | 7.1 | | 19.3 | |
| TEG20 | 5.6 | 20.8 | | 29.2 | | 25.7 | 38.3 | | 18.5 | |
| TEG21 | 11.1 | 9.3 | 11 | 24.2 | 11.9 | 22.4 | 22.3 | 32.1 | 19.2 | 29.2 |
| TEG22 | 79.6 | 92.8 | | 95.3 | | 60.2 | 168.6 | | 71 | |
| TEG23 | 43.9 | 99.8 | | 21.9 | | 47.6 | 35 | | 36.4 | |
| TEG24 | 24.2 | 22.1 | | 49.8 | | 42.6 | 312 | | 12.7 | |
| TEG25 | 43.9 | 3.6 | 565.2 | 9.7 | 13.3 | 8 | 9.6 | 24.5 | 5.7 | 3.2 |
| TEG26 | 45.1 | 38.1 | | 59.2 | | 56.9 | 61.7 | | 50.9 | |
| TEG27 | 22.5 | 57.8 | 10.3 | 17 | 35.1 | 69.2 | 44.4 | 109 | 37.5 | 65.2 |
| TEG28 | 81.4 | 99.6 | 3.5 | 194 | 57.2 | 105.8 | 73.6 | 86.3 | 80.2 | 371.2 |
| TEG29 | 99.6 | 164.9 | | 21.9 | | 52 | 108.6 | | 7.6 | |
| TEG30 | 22.2 | 150.6 | | 314.9 | | 315.2 | 50.8 | | 525.1 | |
| TEG31 | 18.4 | 25.4 | | 30.3 | | 25.4 | 26.7 | | 33.1 | |
| TEG32 | 15 | 17.8 | 10.7 | 28.5 | 15.3 | 15.6 | 24.7 | 33.7 | 17.1 | 45.4 |
| TEG33 | 81.9 | 96.9 | 74.9 | 156.8 | 149.3 | 129.2 | 158.9 | 120.6 | 228.1 | 190.8 |
| TEG34 | 19.4 | 68.1 | 47.3 | 37.3 | 43.3 | 43.8 | 42 | 83 | 27.2 | 19.1 |
| TEG35 | 0.8 | 53.1 | 1.1 | 3.7 | 1 | 1.7 | 1.9 | 1.4 | 3.2 | 15.7 |
| TEG36 | 20 | 4 | 45.3 | 17.3 | 10.9 | 25 | 34.7 | 31.1 | 13 | 33.9 |
| TEG37 | 429.6 | 116.2 | | 14.1 | | 460.7 | 53 | | 45.8 | |
| TEG38 | 231.7 | 369 | 414.2 | 260 | 320.8 | 158.2 | 141.6 | 194 | 37.2 | 105.6 |
| TEG39 | 26.3 | 44.6 | 32.4 | 49.6 | 87.6 | 88.9 | 44.3 | 85.3 | 32 | 41.8 |
| TEG40 | 50.5 | 89.9 | 23.6 | 139.7 | 69 | 105.7 | 91.3 | 115.7 | 123.9 | 147.1 |
| TEG41 | 21.5 | 156.1 | 19.6 | 3.2 | 89.3 | 17.1 | 11.5 | 5.8 | 16.4 | 21.8 |
| TEG42 | 346.4 | 1024.3 | 450.2 | 330.4 | 1279 | 907.8 | 693.5 | 580.3 | 4388.1 | 291.1 |
| TEG43 | 31.3 | 53.3 | 43.6 | 52.7 | 63.1 | 106.4 | 75 | 122.4 | 120.3 | 49.2 |
| TEG44 | 127.4 | 12.3 | 3.6 | 9.8 | 28.2 | 25.5 | 67.2 | 3.7 | 12 | 7 |
| TEG45 | 137.3 | 76.5 | 93.1 | 13.1 | 77.5 | 23.2 | 44.2 | 13.3 | 10.3 | 8.8 |
| TEG46 | 61.4 | 11.8 | | 132.6 | | 15.5 | 54 | | 49.3 | |
| TEG47 | 6 | 4.3 | 2.3 | 69.7 | 84.1 | 366.9 | 56.6 | 194.5 | 25.4 | 1.2 |
| TEG48 | 12.6 | 96.9 | | 134.6 | | 162.9 | 77.8 | | 66.4 | |
| TEG49 | 284.4 | 113.4 | | 76.1 | | 103.2 | 83.2 | | 52.5 | |
| TEG50 | 189.7 | 170.5 | | 205.5 | | 46.4 | 38.8 | | 16.4 | |
| TEG51 | 182.7 | 183.2 | | 103.6 | | 115.4 | 139.2 | | 117.4 | |
| TEG52 | 15.9 | 277.4 | 9 | 85.8 | 21.6 | 8.1 | 27 | 86.3 | 28.2 | 96.4 |
| TEG53 | 15.1 | 54.8 | | 23.4 | | 96.4 | 46.5 | | 33 | |

TABLE 3-continued

| No | | | | | | | | | | |
|---|---|---|---|---|---|---|---|---|---|---|
| TEG54 | 61.6 | 170 | 176.1 | 215.1 | 88.9 | 115.2 | 532.5 | 149.4 | 794.7 | 580.3 |
| TEG55 | 87.5 | 225.9 | 175.9 | 162.1 | 123.6 | 88.4 | 263 | 138.4 | 228.9 | 319 |
| TEG56 | 86.2 | 91.7 | 88.2 | 76.8 | 183.4 | 274.6 | 86.8 | 305 | 80.5 | 75.7 |
| TEG57 | 48.7 | 48 | 90.1 | 97.6 | 54.4 | 89.4 | 60.6 | 119.7 | 84.1 | 95.6 |
| TEG58 | 3.2 | 15.4 | 12.7 | 3.9 | 2.4 | 13.9 | 7 | 20.3 | 8.1 | 31.9 |
| TEG59 | 85.6 | 141.4 | 112.1 | 22.1 | 55.3 | 99.8 | 71.2 | 46.1 | 62.9 | 20.5 |
| TEG60 | 35.3 | 78.2 | 37.7 | 25.8 | 415.5 | 53.9 | 111.1 | 150.6 | 123.6 | 39.2 |
| TEG61 | 5.1 | 5.3 | 5.2 | 10.7 | 5.6 | 8.5 | 9.4 | 8.3 | 8.9 | 10.4 |
| TEG62 | 44.1 | 44.4 | | 112.8 | | 76.5 | 93.6 | | 60.8 | |
| TEG63 | 19.4 | 42.1 | 34.1 | 49.3 | 27.2 | 40.7 | 48.6 | 38.4 | 58.5 | 87.6 |
| TEG64 | 130.2 | 72.6 | 37.7 | 109.6 | 8 | 43.7 | 14.9 | 111.7 | 15.6 | 54 |

| No | Lung squamous cell carcinoma 1 | Lung squamous cell carcinoma 2 | Lung squamous cell carcinoma 3 | Lung squamous cell carcinoma 4 | Lung squamous cell carcinoma 5 | Lung adeno-carcinoma 1 | Lung adeno-carcinoma 2 | Lung adeno-carcinoma 3 | Lung adeno-carcinoma 4 | Lung adeno-carcinoma 5 |
|---|---|---|---|---|---|---|---|---|---|---|
| TEG1 | 23.8 | 14.5 | 22.3 | 15 | 15.5 | 34.4 | 146.7 | 151.3 | 15.4 | 15.7 |
| TEG2 | 50.5 | 17.1 | 13.3 | 32.3 | 14.2 | 3.9 | 22.3 | 6.9 | 694.9 | 91.3 |
| TEG3 | 185.4 | 93.8 | 133.2 | 177.4 | 116.1 | 71.6 | 91.5 | 225.4 | 46.8 | 301.7 |
| TEG4 | 27.3 | 45.4 | 48.6 | 34.5 | 31.5 | 17.8 | 28.6 | 31.6 | 25.5 | 29.8 |
| TEG5 | 90 | 85.9 | 33.6 | 97.3 | 70.4 | 76.1 | 48.8 | 46.2 | 22.5 | 56.4 |
| TEG6 | 30.4 | 75 | 19.2 | 103.1 | 28.7 | 3250.3 | 92.3 | 125.6 | 103.8 | 77.2 |
| TEG7 | 471.4 | 150.9 | 315 | 291.7 | 768.2 | 219.9 | 157.3 | 237.6 | 515.9 | 334.2 |
| TEG8 | 19.6 | 37 | 8.7 | 28.6 | 12.8 | 14.7 | 107 | 12.4 | 226.1 | 57.7 |
| TEG9 | 53.5 | 29.9 | 15.8 | 68.4 | 13.5 | 102.2 | 33.2 | 54.4 | 68.4 | 101.6 |
| TEG10 | 102.3 | 327.3 | 152.1 | 275.3 | 42.4 | 148.7 | 91.5 | 208.7 | 143.1 | 192.8 |
| TEG11 | 956.2 | 165.2 | 897.4 | 1548.3 | 160.2 | 385.4 | 553.7 | 225.1 | 265.2 | 1162.5 |
| TEG12 | 49.2 | 92.8 | 50.4 | 84.9 | 41.7 | 29.2 | 35.4 | 37.1 | 54.8 | 32.7 |
| TEG13 | 2.2 | 14 | 18.1 | 7.5 | 19.3 | 28.5 | 5 | 14.5 | 49.9 | 38.5 |
| TEG14 | 67.4 | 148.4 | 137.5 | 119.6 | 78.6 | 55.1 | 28.9 | 117 | 132.7 | 58.1 |
| TEG15 | 19.4 | 35.2 | 24.3 | 13 | 14.2 | 495.8 | 48.8 | 49.7 | 9.4 | 115.3 |
| TEG16 | 24.9 | 15.7 | 105.4 | 26 | 15 | 47.1 | 72.2 | 48.1 | 55.9 | 112.1 |
| TEG17 | 45.8 | 202.3 | 234.2 | 111.1 | 132.2 | 6.4 | 7 | 49.3 | 67.1 | 14 |
| TEG18 | 242.2 | 116.9 | 115.9 | 105.7 | 99.9 | 52.2 | 113.2 | 82 | 78.9 | 922.8 |
| TEG19 | 14.8 | 27.7 | 41 | 27.3 | 36.8 | 162.8 | 46.1 | 9.4 | 41.6 | 6.1 |
| TEG20 | 33.9 | 31 | 28.8 | 32.9 | 60.6 | 27.8 | 18 | 33.8 | 14.1 | 28.6 |
| TEG21 | 10.9 | 10 | 2.5 | 10.9 | 12.1 | 13.8 | 8.8 | 9.3 | 9.6 | 9 |
| TEG22 | 67.8 | 105 | 42.4 | 117 | 79.5 | 107 | 66.7 | 60.1 | 61.9 | 75.9 |
| TEG23 | 41.3 | 44.6 | 37.2 | 34.8 | 40.8 | 12.3 | 31.5 | 20.4 | 290.2 | 29.7 |
| TEG24 | 8.1 | 34.9 | 32.3 | 23.9 | 23.4 | 2 | 28.4 | 19.2 | 21.2 | 22.3 |
| TEG25 | 11.3 | 9.4 | 11.7 | 13.5 | 7.3 | 7.2 | 11.6 | 1.6 | 3 | 1.5 |
| TEG26 | 38 | 27.5 | 13 | 40.9 | 16.7 | 37.3 | 26.2 | 49 | 22.5 | 46.9 |
| TEG27 | 39.1 | 5.6 | 22 | 21.3 | 72.3 | 20.7 | 33.9 | 65.2 | 15 | 31.4 |
| TEG28 | 49.5 | 31.1 | 29.7 | 43.2 | 44 | 156.7 | 121.4 | 128.3 | 35 | 168.3 |
| TEG29 | 56.8 | 152.4 | 147 | 85.5 | 207 | 272.5 | 85.3 | 333.1 | 35.1 | 34.6 |
| TEG30 | 59.6 | 105.6 | 47.8 | 56.4 | 9 | 139.8 | 66.4 | 7.2 | 132.6 | 54.1 |
| TEG31 | 28 | 24.1 | 21.1 | 29.6 | 25 | 276.7 | 134.4 | 94.7 | 22.5 | 22.2 |
| TEG32 | 51.4 | 342.9 | 313.3 | 486.4 | 164.8 | 189.4 | 34.6 | 112.5 | 13.2 | 395.4 |
| TEG33 | 138.6 | 102.6 | 122.5 | 100.1 | 151.7 | 66.5 | 76.8 | 79.3 | 90.7 | 71.4 |
| TEG34 | 38.9 | 45 | 44.5 | 45.4 | 59.5 | 57 | 61.4 | 90.9 | 51.5 | 53.1 |
| TEG35 | 2.2 | 1.8 | 1.9 | 1.1 | 1.6 | 5.3 | 1 | 0.9 | 73 | 2.2 |
| TEG36 | 16.2 | 14.5 | 21.5 | 22.1 | 5.2 | 16.1 | 29.3 | 11.1 | 14.8 | 132.4 |
| TEG37 | 36.9 | 269 | 18 | 4 | 619.9 | 52.9 | 82.4 | 111.7 | 101.3 | 20.4 |
| TEG38 | 837.4 | 123.8 | 178.1 | 258.3 | 194.8 | 163.9 | 454 | 239.1 | 86.7 | 2007.7 |
| TEG39 | 121.2 | 51.5 | 104.7 | 82.2 | 55.6 | 48.5 | 90.6 | 45.6 | 58 | 71.8 |
| TEG40 | 88.1 | 83.1 | 92.7 | 93.6 | 71.2 | 218.9 | 92 | 152.2 | 80.8 | 137.8 |
| TEG41 | 85.7 | 4.9 | 7.8 | 36.8 | 178.7 | 77.2 | 139.3 | 4.2 | 29.1 | 2.3 |
| TEG42 | 367.6 | 721.1 | 309 | 476.1 | 330.1 | 594.7 | 189.2 | 773.8 | 380.4 | 472.7 |
| TEG43 | 109.8 | 48.3 | 323 | 231.4 | 83.2 | 40 | 88.4 | 101.5 | 68 | 192.2 |
| TEG44 | 3 | 2.6 | 4.8 | 16.4 | 2.9 | 3.6 | 9.2 | 0.5 | 12.9 | 1.7 |
| TEG45 | 66.3 | 34.7 | 41.5 | 45.1 | 56.2 | 4 | 95.3 | 53.8 | 21.4 | 208.3 |
| TEG46 | 52.5 | 73.5 | 25.8 | 32.7 | 4.7 | 108.2 | 60 | 93.9 | 79.8 | 93.2 |
| TEG47 | 21.1 | 34.4 | 8.4 | 24.1 | 22.5 | 320.6 | 365.1 | 13.4 | 204.3 | 140.7 |
| TEG48 | 21.9 | 73.7 | 103.9 | 79.3 | 100.4 | 328.4 | 75.6 | 356.5 | 87.4 | 227.4 |
| TEG49 | 121.9 | 122.3 | 233.2 | 78.1 | 156.3 | 53 | 57 | 113.1 | 69.1 | 84.7 |
| TEG50 | 94.1 | 87.9 | 117.7 | 21.7 | 15.9 | 189.5 | 17.3 | 80 | 81.2 | 78 |
| TEG51 | 72.5 | 91 | 93.3 | 62.2 | 70.2 | 89.5 | 33.4 | 170.5 | 127.9 | 65.7 |
| TEG52 | 525.6 | 99.7 | 80 | 890.4 | 453.4 | 19.5 | 290.3 | 975 | 7.4 | 434.6 |
| TEG53 | 136.1 | 113.3 | 86.1 | 180.9 | 133.2 | 62 | 103.5 | 249.9 | 77.9 | 42.8 |
| TEG54 | 3.8 | 3.8 | 0.8 | 1.8 | 110.8 | 456.3 | 172.3 | 182.9 | 101.4 | 20.6 |
| TEG55 | 19.1 | 188 | 42.7 | 57.7 | 298.1 | 159 | 139.2 | 129.5 | 43.6 | 35.2 |
| TEG56 | 522.5 | 141.3 | 441 | 549 | 185.5 | 79.5 | 518.5 | 237.9 | 112.6 | 496.4 |
| TEG57 | 22.3 | 85.5 | 18.1 | 38 | 20.7 | 432.7 | 41.6 | 50.4 | 55.6 | 32.7 |
| TEG58 | 7.3 | 6.7 | 31.7 | 12.4 | 5.1 | 32.2 | 13.4 | 2.2 | 3.8 | 12.4 |
| TEG59 | 42.8 | 78 | 79.8 | 72.1 | 45.3 | 70.1 | 21.5 | 99.8 | 81.8 | 106.1 |
| TEG60 | 40.5 | 38.9 | 11.9 | 22.8 | 26.5 | 87.8 | 21.1 | 109.3 | 26.8 | 8.7 |
| TEG61 | 5.7 | 4.9 | 6.8 | 5.3 | 6.1 | 5.6 | 3.3 | 2.6 | 4.5 | 66.6 |
| TEG62 | 79.5 | 63 | 61.6 | 69 | 50.9 | 547.9 | 787.8 | 533 | 9.7 | 67.2 |

TABLE 3-continued

| | | | | | | | | | | |
|---|---|---|---|---|---|---|---|---|---|---|
| TEG63 | 47.2 | 43.2 | 65.5 | 43.3 | 17.7 | 39.3 | 28.8 | 41.4 | 17.7 | 22 |
| TEG64 | 11.7 | 36.3 | 9.6 | 10.5 | 8 | 59.8 | 20.8 | 42 | 101.5 | 33.6 |

| No | Renal cancer 1 | Renal cancer 2 | Large bowel cancer 1 | Large bowel cancer 2 | Large bowel cancer 3 | Large bowel cancer 4 | Large bowel cancer 5 | Large bowel cancer 6 | Large bowel cancer 7 | Metastatic tissue of Large bowel cancer (liver) 1 |
|---|---|---|---|---|---|---|---|---|---|---|
| TEG1 | 13.8 | 17.1 | | | | | | | | 12 |
| TEG2 | 10.5 | 5.7 | | | | | | | | 421.5 |
| TEG3 | 146.3 | 117.8 | | | | | | | | 306.3 |
| TEG4 | 32.3 | 33.6 | | | | | | | | 17.5 |
| TEG5 | 61.9 | 92.7 | | | | | | | | 55.9 |
| TEG6 | 82.6 | 24.6 | | | | | | | | 46 |
| TEG7 | 115.3 | 61.9 | | | | | | | | 356.9 |
| TEG8 | 12.2 | 23.2 | | | | | | | | 15.2 |
| TEG9 | 27.5 | 123 | | | | | | | | 113.9 |
| TEG10 | 64.2 | 133.4 | | | | | | | | 171.7 |
| TEG11 | 28.2 | 68.5 | | | | | | | | 1120.1 |
| TEG12 | 81.3 | 69 | | | | | | | | 88.8 |
| TEG13 | 7.4 | 22.5 | | | | | | | | 41.9 |
| TEG14 | 5.1 | 5.8 | 38.5 | 124.2 | 136.2 | 34 | 11.9 | 119.5 | 128.8 | 96 |
| TEG15 | 12.7 | 72.8 | | | | | | | | 159 |
| TEG16 | 12.5 | 188.7 | | | | | | | | 61.5 |
| TEG17 | 9.7 | 10.9 | | | | | | | | 69.7 |
| TEG18 | 320.4 | 257.2 | | | | | | | | 130.8 |
| TEG19 | 22.6 | 6.8 | | | | | | | | 11 |
| TEG20 | 16.8 | 12.1 | | | | | | | | 30.7 |
| TEG21 | 12.6 | 12.6 | 8.4 | 8.2 | 9.2 | 7.4 | 10.9 | 7.5 | 9.9 | 9.9 |
| TEG22 | 25.2 | 20.8 | | | | | | | | 64.3 |
| TEG23 | 48.5 | 40.5 | | | | | | | | 36.3 |
| TEG24 | 18.9 | 40.1 | | | | | | | | 162.6 |
| TEG25 | 2.7 | 7 | 219.7 | 22.6 | 163.7 | 58.8 | 50.7 | 9.3 | 724.2 | 419.1 |
| TEG26 | 43.3 | 64.4 | | | | | | | | 71.9 |
| TEG27 | 19.3 | 5.6 | 264 | 192.6 | 111.7 | 304.8 | 281.6 | 102.6 | 128.8 | 78.9 |
| TEG28 | 59.3 | 25.9 | 220.4 | 261.6 | 110.5 | 411.1 | 370.7 | 191.7 | 268.4 | 256.8 |
| TEG29 | 2.6 | 9.3 | | | | | | | | 38.3 |
| TEG30 | 43.9 | 229.7 | | | | | | | | 30 |
| TEG31 | 32 | 42.3 | | | | | | | | 102.7 |
| TEG32 | 13.6 | 13.3 | 447.7 | 477 | 680.9 | 1074.1 | 1333.7 | 325.3 | 886.5 | 505.8 |
| TEG33 | 93.5 | 76.5 | 530.3 | 603.1 | 137.9 | 708.7 | 562.8 | 494.7 | 433.9 | 95.6 |
| TEG34 | 38.6 | 61.2 | 94.8 | 219.4 | 336.2 | 213.7 | 102.1 | 101.7 | 165.6 | 142.9 |
| TEG35 | 1.7 | 1 | 1.1 | 1.2 | 1.7 | 1.5 | 1.9 | 1 | 1.4 | 1 |
| TEG36 | 14.8 | 8.3 | 31.4 | 62.8 | 64 | 43.4 | 44 | 24.4 | 30.4 | 83.2 |
| TEG37 | 96 | 6.5 | | | | | | | | 264.3 |
| TEG38 | 607.9 | 590.3 | 411.5 | 699 | 706.8 | 508.4 | 689.7 | 321.2 | 252.9 | 637 |
| TEG39 | 66.9 | 48.4 | 344.6 | 522.8 | 390.1 | 926.4 | 864.1 | 580.5 | 418.5 | 583.3 |
| TEG40 | 191.2 | 165 | 272.4 | 233.4 | 194.8 | 398.1 | 340.8 | 263.2 | 123 | 100.7 |
| TEG41 | 6.4 | 2.6 | 51.7 | 144.7 | 35.9 | 299.5 | 359.1 | 310.8 | 318.3 | 29 |
| TEG42 | 57.7 | 44.8 | 773.3 | 542.7 | 606.6 | 491.9 | 519.3 | 313.2 | 630 | 750.9 |
| TEG43 | 33.6 | 41.6 | 422.9 | 78.6 | 53.7 | 256.3 | 134.6 | 143.4 | 73.8 | 201.1 |
| TEG44 | 3.8 | 2.9 | 3.2 | 0.6 | 1.9 | 13 | 7.4 | 10.2 | 6.1 | 1.7 |
| TEG45 | 10.2 | 24.7 | 288.2 | 44.6 | 36.9 | 13.9 | 8.6 | 71.9 | 48.5 | 112.8 |
| TEG46 | 15.1 | 13.7 | | | | | | | | 9.7 |
| TEG47 | 7.4 | 5.1 | 1938 | 21.2 | 454.5 | 39.2 | 225.4 | 7 | 68.6 | 318.5 |
| TEG48 | 67 | 22 | | | | | | | | 238.3 |
| TEG49 | 106.7 | 33.8 | | | | | | | | 179.6 |
| TEG50 | 15.4 | 13.6 | | | | | | | | 135.9 |
| TEG51 | 27.6 | 62.9 | | | | | | | | 97.7 |
| TEG52 | 5.2 | 5.9 | 252.9 | 38.2 | 102.9 | 121.2 | 319.1 | 122.8 | 146.1 | 195.9 |
| TEG53 | 153.5 | 65.1 | | | | | | | | 84.9 |
| TEG54 | 13.8 | 69.7 | 316.9 | 701.3 | 1196.9 | 1061.4 | 1212.2 | 574.8 | 847.9 | 912.6 |
| TEG55 | 38.1 | 52.5 | 217.9 | 239.9 | 519.8 | 619.7 | 551.6 | 294 | 382.5 | 448.4 |
| TEG56 | 55.9 | 62.3 | 93.4 | 45.2 | 124.9 | 55.5 | 48.6 | 56.6 | 157.7 | 98.1 |
| TEG57 | 27.3 | 33.3 | 219.6 | 58.8 | 28.7 | 37.3 | 66.5 | 21.1 | 38.1 | 32.4 |
| TEG58 | 19.7 | 13.2 | 3.4 | 5.4 | 26 | 12 | 1 | 8.4 | 7.7 | 2.7 |
| TEG59 | 15.6 | 20.6 | 68.3 | 184.9 | 222.7 | 102 | 49.2 | 140.5 | 121.9 | 115.7 |
| TEG60 | 27 | 35 | 59.2 | 34.4 | 16.5 | 23.8 | 6.4 | 28.9 | 30.1 | 24.8 |
| TEG61 | 8.8 | 4.8 | 3.9 | 7.6 | 5.2 | 4.3 | 3.6 | 11.5 | 4.5 | 3.1 |
| TEG62 | 78.1 | 77.9 | | | | | | | | 60.6 |
| TEG63 | 30.5 | 29.1 | 32.6 | 22.7 | 16.7 | 17.7 | 30.1 | 16 | 16.6 | 34.9 |
| TEG64 | 9.6 | 10.2 | 10.9 | 47.5 | 18.3 | 26.3 | 59.8 | 9.3 | 32.6 | 19.3 |

TABLE 3-continued

| No | Metastatic tissue of large bowel cancer (liver) 2 | Metastatic tissue of large bowel cancer (liver) 3 | Metastatic tissue of large bowel cancer (liver) 4 | Metastatic tissue of large bowel cancer (liver) 5 | Metastatic tissue of large bowel cancer (liver) 6 | Metastatic tissue of large bowel cancer (liver) 7 | Pancreatic cancer 1 | Pancreatic cancer 2 | Pancreatic cancer 3 | Pancreatic cancer 4 |
|---|---|---|---|---|---|---|---|---|---|---|
| TEG1 | 14.6 | 12.7 | | | | | 261.9 | 10.3 | 17.2 | |
| TEG2 | 564.6 | 750.8 | | | | | 4.5 | 5.6 | 28.7 | |
| TEG3 | 88.4 | 515.3 | | | | | 208.4 | 51.9 | 143.5 | |
| TEG4 | 42.2 | 131.4 | | | | | 38.6 | 39.1 | 48.4 | |
| TEG5 | 54.4 | 84.2 | | | | | 36.2 | 56.2 | 182.1 | |
| TEG6 | 24 | 194.8 | | | | | 166.5 | 12.2 | 18.6 | |
| TEG7 | 476.3 | 987.4 | | | | | 387.9 | 65.6 | 212.3 | |
| TEG8 | 23.6 | 11.5 | | | | | 29.7 | 26.4 | 10.7 | |
| TEG9 | 41.7 | 189.8 | | | | | 135.3 | 79 | 96 | |
| TEG10 | 138 | 138 | | | | | 130.8 | 5.9 | 55.8 | |
| TEG11 | 1224.2 | 229.8 | | | | | 1772.5 | 340.2 | 1010.5 | |
| TEG12 | 38.2 | 52.6 | | | | | 48.3 | 51.5 | 67.2 | |
| TEG13 | 25.8 | 2.8 | | | | | 29 | 12.1 | 14.2 | |
| TEG14 | 109.4 | 270.3 | 5.6 | 107.4 | 30.6 | 107.8 | 95.5 | 78.6 | 32.5 | 125.1 |
| TEG15 | 6.3 | 310.2 | | | | | 13.4 | 9.5 | 55.6 | |
| TEG16 | 18.1 | 17.2 | | | | | 21.3 | 348.5 | 13 | |
| TEG17 | 83 | 179 | | | | | 14.9 | 43.3 | 145 | |
| TEG18 | 100.4 | 193.5 | | | | | 146.8 | 46.9 | 56.7 | |
| TEG19 | 8.9 | 6.4 | | | | | 22.3 | 13 | 11.7 | |
| TEG20 | 34.5 | 110 | | | | | 15 | 14.4 | 22.5 | |
| TEG21 | 11.4 | 11 | 53.7 | 12.1 | 11.8 | 11.3 | 2.6 | 5.4 | 9.2 | 14.7 |
| TEG22 | 74.2 | 57.8 | | | | | 108.5 | 12.3 | 69.3 | |
| TEG23 | 29.3 | 21.2 | | | | | 39.3 | 16.3 | 18.4 | |
| TEG24 | 361.9 | 296.8 | | | | | 24.5 | 2.6 | 45.2 | |
| TEG25 | 459.2 | 523.5 | 24.4 | 988.6 | 193.3 | 194.4 | 1.3 | 14.6 | 9.2 | 5.4 |
| TEG26 | 39.3 | 45.9 | | | | | 84.2 | 58.2 | 640.4 | |
| TEG27 | 163.6 | 213.3 | 4.2 | 243.5 | 129.4 | 241.2 | 36.2 | 19.8 | 41.7 | 78.9 |
| TEG28 | 121.7 | 322.8 | 2.7 | 248.3 | 232.8 | 390.6 | 202 | 221.8 | 120 | 161.3 |
| TEG29 | 32.4 | 639.4 | | | | | 46.9 | 3 | 1.3 | |
| TEG30 | 63 | 8 | | | | | 65.7 | 283.1 | 29.8 | |
| TEG31 | 27.9 | 23.3 | | | | | 129.2 | 27.9 | 26.7 | |
| TEG32 | 627.8 | 816.1 | 13 | 451 | 280.2 | 434.1 | 178.6 | 178.1 | 159.3 | 298.1 |
| TEG33 | 72.2 | 87.9 | 119.5 | 83.6 | 85.7 | 86.9 | 50.2 | 32.7 | 266.3 | 90.4 |
| TEG34 | 210 | 198.6 | 10.4 | 174.9 | 197.1 | 195.5 | 52.7 | 13.5 | 60.1 | 110 |
| TEG35 | 0.8 | 1.2 | 1.2 | 1.6 | 1.1 | 3.5 | 0.9 | 0.6 | 1.6 | 1.7 |
| TEG36 | 41.7 | 39.8 | 15.7 | 54.5 | 129.6 | 41.9 | 27.5 | 8.2 | 92.3 | 14.9 |
| TEG37 | 365.9 | 245.4 | | | | | 282.6 | 43.7 | 549.5 | |
| TEG38 | 392.7 | 412.9 | 57.6 | 963.9 | 737.1 | 1337.9 | 346.5 | 11.8 | 243.7 | 1271.5 |
| TEG39 | 524.9 | 510.6 | 34 | 591.1 | 382.2 | 266.2 | 144.1 | 34.6 | 544 | 141.1 |
| TEG40 | 134.9 | 113.2 | 22.5 | 166.4 | 45.8 | 262.1 | 82 | 400.6 | 100.3 | 140.6 |
| TEG41 | 114.3 | 61.6 | 6.9 | 160.9 | 244.4 | 74 | 102.4 | 105.5 | 75.5 | 109.5 |
| TEG42 | 698.9 | 719.7 | 407.8 | 560.9 | 605.4 | 728 | 483.2 | 206.1 | 588.1 | 901.3 |
| TEG43 | 202.1 | 391.6 | 22.3 | 315.7 | 60.6 | 155.8 | 99.2 | 19.3 | 46.8 | 42.4 |
| TEG44 | 2.9 | 3 | 80.3 | 3.3 | 1.8 | 3.5 | 2.5 | 3.8 | 3.1 | 1.2 |
| TEG45 | 75.9 | 25 | 16.3 | 34.1 | 85.4 | 38.4 | 74.6 | 77.3 | 22.1 | 48.3 |
| TEG46 | 30.4 | 3.9 | | | | | 14.3 | 310.5 | 5 | |
| TEG47 | 45 | 21 | 3.1 | 91.9 | 26.7 | 156 | 306.7 | 6.2 | 207.4 | 11.7 |
| TEG48 | 113.8 | 91.6 | | | | | 110.7 | 543 | 52.4 | |
| TEG49 | 150.7 | 317.1 | | | | | 181.8 | 189.3 | 191.9 | |
| TEG50 | 114.5 | 545.3 | | | | | 128.9 | 19.3 | 96.5 | |
| TEG51 | 117 | 186.2 | | | | | 198.9 | 82.9 | 63.8 | |
| TEG52 | 122 | 60.7 | 12.4 | 16.6 | 18.3 | 9.2 | 404.8 | 2.5 | 17.3 | 593.6 |
| TEG53 | 81 | 210.2 | | | | | 45 | 9.1 | 15.7 | |
| TEG54 | 632.7 | 462.6 | 65.7 | 656.4 | 686.5 | 519.7 | 21 | 420.1 | 240.7 | 60.8 |
| TEG55 | 371.5 | 354.1 | 3.3 | 337.8 | 684.3 | 269.8 | 271.9 | 81.5 | 199.8 | 300.5 |
| TEG56 | 159.8 | 44.6 | 56.1 | 78.3 | 147.6 | 62.8 | 150.9 | 11.8 | 329.6 | 52.7 |
| TEG57 | 27.1 | 39 | 50.6 | 36.5 | 30.7 | 53.2 | 18.3 | 56.1 | 15.1 | 6.1 |
| TEG58 | 4.5 | 3.5 | 21.8 | 8 | 14.9 | 3.2 | 6.7 | 14.6 | 22.3 | 16.7 |
| TEG59 | 65.1 | 183.2 | 4.2 | 116.5 | 47.6 | 166.4 | 92 | 106.2 | 36.3 | 119.8 |
| TEG60 | 20.4 | 27.9 | 64.9 | 8.4 | 27.5 | 27.7 | 9.3 | 3.2 | 19.9 | 57.7 |
| TEG61 | 5.1 | 5.9 | 7.2 | 5.1 | 7.4 | 5 | 202.4 | 2.3 | 3.2 | 6.3 |
| TEG62 | 77.1 | 78.1 | | | | | 358.7 | 2454.5 | 230.5 | |
| TEG63 | 25.2 | 28.9 | 45.1 | 29.6 | 29.6 | 28.9 | 28.8 | 51.7 | 30.4 | 35.8 |
| TEG64 | 24.1 | 19.5 | 5.8 | 10.2 | 5.1 | 9.3 | 43.9 | 184 | 8.8 | 41.8 |

TABLE 4

| No | Lung small cell lung cancer 1 | Lung small cell lung cancer 2 | Lung small cell lung cancer 3 | Lung small cell lung cancer 4 | Lung small cell lung cancer 5 | Lung small cell lung cancer 6 | Lung small cell lung cancer 7 | Lung small cell lung cancer 8 | Lung small cell lung cancer 9 | Lung small cell lung cancer 10 |
|---|---|---|---|---|---|---|---|---|---|---|
| TEG1 | 3.7 | 4.4 | 13.4 | 19.5 | 3.5 | 31.6 | 4 | 9.3 | 23.2 | 2 |
| TEG2 | 49.9 | 47.4 | 111.8 | 35.7 | 3.1 | 13.4 | 231.8 | 1.2 | 428.3 | 290.7 |
| TEG3 | 58.7 | 47.6 | 77.9 | 74.1 | 38.2 | 100.7 | 14.2 | 30.5 | 57.9 | 121.2 |
| TEG4 | 8.4 | 16.9 | 12.3 | 13.1 | 9.1 | 18.8 | 13.7 | 2.4 | 1.6 | 8.5 |
| TEG5 | 24 | 0.7 | 22.3 | 41.1 | 2.3 | 1.3 | 6.5 | 12.5 | 8.5 | 6.7 |
| TEG6 | 45.8 | 55.7 | 46.9 | 19.1 | 57.3 | 8.7 | 38.6 | 38.9 | 248.4 | 15.2 |
| TEG7 | 875.1 | 767.9 | 727 | 562.7 | 1360 | 1276 | 776.1 | 1122 | 528.3 | 1357 |
| TEG8 | 34.3 | 1.4 | 4.5 | 26.5 | 2.8 | 3 | 2.3 | 4.5 | 2.4 | 2.6 |
| TEG9 | 18 | 30.6 | 29.6 | 12.3 | 19.5 | 26.5 | 15.1 | 6.2 | 10.6 | 56.2 |
| TEG10 | 455 | 135.7 | 37.3 | 408.1 | 56.2 | 4340 | 29.8 | 35.8 | 34.7 | 33.1 |
| TEG11 | 221.9 | 1359 | 71.7 | 517.3 | 457.3 | 483 | 472.3 | 301.5 | 387.8 | 210.7 |
| TEG12 | 43.3 | 9.2 | 4.1 | 24.4 | 15.6 | 13.1 | 30.6 | 33.2 | 11.1 | 40.3 |
| TEG13 | 64.9 | 11.9 | 11.4 | 5.2 | 12.6 | 8.4 | 22 | 6.9 | 4.7 | 8.9 |
| TEG14 | 667.4 | 1026 | 842.2 | 1322 | 1192 | 1229 | 912.9 | 776.5 | 665.8 | 2045 |
| TEG15 | 120.5 | 14.5 | 73.7 | 55.5 | 49.2 | 25.1 | 89.6 | 169.1 | 356.3 | 36.6 |
| TEG16 | 80.9 | 855.6 | 122.8 | 188.5 | 113.6 | 39.4 | 120.5 | 166.2 | 57.7 | 70.8 |
| TEG17 | 3.2 | 44.7 | 75.3 | 19.7 | 2.8 | 53 | 3 | 5.4 | 1 | 15.1 |
| TEG18 | 39.6 | 7.1 | 39.9 | 129.8 | 23.8 | 63.1 | 22.6 | 77.3 | 90.4 | 140.3 |
| TEG19 | 104.1 | 172.1 | 169.1 | 158.2 | 80.9 | 212.3 | 231.7 | 116.3 | 118.9 | 4.8 |
| TEG20 | 3.8 | 1.9 | 1.8 | 10.2 | 3.6 | 1.2 | 3.9 | 1.9 | 15.9 | 1.1 |
| TEG21 | 10 | 9.2 | 5.7 | 2.9 | 2.6 | 8.9 | 5.4 | 7.2 | 2 | 3.4 |
| TEG22 | 86.8 | 63.5 | 60.4 | 45.2 | 180.4 | 42.6 | 94 | 68.8 | 60.8 | 43.3 |
| TEG23 | 8.7 | 1.1 | 1.3 | 22.4 | 1.9 | 23.1 | 8.8 | 0.7 | 7.4 | 1.1 |
| TEG24 | 153.1 | 1087 | 45.9 | 22.1 | 735.3 | 27.5 | 23.6 | 35.4 | 1062 | 263.4 |
| TEG25 | 34.7 | 18 | 79.3 | 43.1 | 8.7 | 16.7 | 142.9 | 13.3 | 77.7 | 13.1 |
| TEG26 | 19.2 | 2.7 | 18.3 | 20.7 | 30.7 | 28.7 | 20.7 | 29.8 | 8.9 | 14.1 |
| TEG27 | 77.4 | 8.6 | 45 | 100 | 17.6 | 67.3 | 292.9 | 142.3 | 27.8 | 54.7 |
| TEG28 | 1.5 | 20.5 | 25.7 | 45.3 | 59.1 | 38.2 | 167.4 | 80.5 | 81.1 | 91.9 |
| TEG29 | 78.5 | 16.9 | 0.6 | 0.7 | 1.9 | 0.8 | 79.9 | 20.1 | 20.4 | 512.7 |
| TEG30 | 85.3 | 169.6 | 5.1 | 34 | 242.9 | 155 | 145.2 | 338.2 | 19 | 13.1 |
| TEG31 | 15.5 | 5.4 | 7.3 | 20.6 | 3.4 | 3.9 | 3 | 3.2 | 5 | 24.2 |
| TEG32 | 38.9 | 25.3 | 1.4 | 6.3 | 179.6 | 26.9 | 37.5 | 22.9 | 114.5 | 74.4 |
| TEG33 | 54.4 | 41.7 | 36 | 65.4 | 41.6 | 18 | 39 | 23.5 | 39 | 19.1 |
| TEG34 | 44.9 | 55.7 | 98.1 | 86.3 | 41.6 | 53.5 | 80.1 | 55.5 | 158.2 | 105.5 |
| TEG35 | 2.3 | 13.1 | 31.2 | 4.8 | 34.9 | 1.2 | 1 | 2.4 | 23.6 | 2.7 |
| TEG36 | 2.8 | 2.3 | 1 | 8.7 | 1.8 | 6.9 | 18.5 | 4.9 | 17.3 | 0.9 |
| TEG37 | 5.2 | 16.3 | 12.3 | 7.7 | 42.5 | 40.7 | 2 | 61 | 25.5 | 8.8 |
| TEG38 | 28 | 6.7 | 47.3 | 906.4 | 117.2 | 224.5 | 3.6 | 56.1 | 317.6 | 382 |
| TEG39 | 43.8 | 80.1 | 15.6 | 45.8 | 44.4 | 40.5 | 41.1 | 31.8 | 20.6 | 20.9 |
| TEG40 | 35.4 | 2.7 | 67.5 | 160.4 | 137 | 49.1 | 78.5 | 127.7 | 271 | 127.7 |
| TEG41 | 41.2 | 18.4 | 17.4 | 1.5 | 3.3 | 15.6 | 24.3 | 6.2 | 7.7 | 27.7 |
| TEG42 | 5124 | 2702 | 5147 | 7568 | 3703 | 1016 | 2857 | 9793 | 8120 | 1220 |
| TEG43 | 17.7 | 100.1 | 21.4 | 81.1 | 216 | 93.4 | 97.6 | 14.5 | 126.7 | 81.6 |
| TEG44 | 169.1 | 398.1 | 216.4 | 279 | 5.4 | 88.5 | 217.3 | 227.4 | 119 | 352.9 |
| TEG45 | 576.4 | 1377 | 196.8 | 1091 | 1236 | 1573 | 911.3 | 126.4 | 922.9 | 317 |
| TEG46 | 28.7 | 22.2 | 39.7 | 27.7 | 20.7 | 38.9 | 31.3 | 7.2 | 24.7 | 23.8 |
| TEG47 | 23.9 | 32.8 | 1 | 11.2 | 23.7 | 36.4 | 15.8 | 38.1 | 306.6 | 40.4 |
| TEG48 | 30.8 | 15.4 | 24.8 | 25 | 62.9 | 41.3 | 36 | 67.7 | 110.3 | 57.1 |
| TEG49 | 249.5 | 332.5 | 345.8 | 342.6 | 411.7 | 486.8 | 368.1 | 313.3 | 389.1 | 425.4 |
| TEG50 | 6.2 | 11.2 | 29.9 | 3.5 | 21 | 17.7 | 80.1 | 38.6 | 3 | 30.5 |
| TEG51 | 357.8 | 954.4 | 708.5 | 450.9 | 860.5 | 579.8 | 394.3 | 851 | 397.3 | 744.5 |
| TEG52 | 37.7 | 6.2 | 27.6 | 142.4 | 7.4 | 8 | 348.5 | 16.5 | 9.7 | 19 |
| TEG53 | 37.8 | 17.1 | 44.8 | 25.7 | 36.9 | 8.5 | 35.5 | 30.5 | 32.8 | 18.5 |
| TEG54 | 5.7 | 41.6 | 157.5 | 103.9 | 513.7 | 113.5 | 70.7 | 236.4 | 908.8 | 711.3 |
| TEG55 | 50.3 | 32.1 | 23.4 | 59.7 | 224.2 | 71.1 | 83.1 | 96.1 | 91.5 | 208.9 |
| TEG56 | 5 | 268.5 | 31.5 | 168.7 | 433.9 | 43.4 | 153.9 | 24.7 | 51.3 | 32.8 |
| TEG57 | 1.4 | 17.6 | 6 | 49 | 105.8 | 38.5 | 35.8 | 271.7 | 233.7 | 101.6 |
| TEG58 | 36.3 | 1.9 | 13.2 | 8.8 | 11.2 | 2.2 | 14.3 | 3.3 | 22.6 | 8.8 |
| TEG59 | 740.8 | 763.7 | 1562 | 514.2 | 726.6 | 722.3 | 806.7 | 1279 | 353.5 | 1412 |
| TEG60 | 54 | 67.4 | 47.4 | 1418 | 21.4 | 243.9 | 493.2 | 149.9 | 58.9 | 32.5 |
| TEG61 | 2.6 | 2.6 | 1.1 | 1.1 | 2.7 | 3.3 | 2.1 | 2.6 | 2.8 | 1.4 |
| TEG62 | 27.3 | 9.1 | 10.9 | 52.6 | 17.8 | 12.3 | 16.1 | 14.6 | 14.8 | 13.3 |
| TEG63 | 44.3 | 15.5 | 27.3 | 23.9 | 24.2 | 5 | 26.8 | 4.1 | 34.7 | 24.4 |
| TEG64 | 15.6 | 7.4 | 6.4 | 37.1 | 21.2 | 85.1 | 34 | 3.3 | 29.1 | 14.4 |

| No | Lung small cell lung cancer 11 | Lung small cell lung cancer 12 | Lung small cell lung cancer 13 | Lung small cell lung cancer 14 | Lung small cell lung cancer 15 | Lung small cell lung cancer 16 | Lung small cell lung cancer 17 | Lung small cell lung cancer 18 | Lung small cell lung cancer 19 | Lung small cell lung cancer 20 |
|---|---|---|---|---|---|---|---|---|---|---|
| TEG1 | 48.5 | 5.4 | 2.3 | 5.2 | 2.5 | 12.7 | 1.7 | 3.5 | 3.5 | 3.3 |
| TEG2 | 47.1 | 86.4 | 201.4 | 1000 | 194.4 | 384.6 | 1017 | 85.5 | 866.4 | 273.9 |
| TEG3 | 40.3 | 104.2 | 162.2 | 296 | 59.9 | 115.6 | 329.7 | 196.2 | 108 | 241.8 |
| TEG4 | 10.2 | 8.8 | 6.6 | 20.6 | 19.7 | 9.5 | 4.9 | 3.1 | 10.2 | 1.5 |

TABLE 4-continued

| No | | | | | | | | | | |
|---|---|---|---|---|---|---|---|---|---|---|
| TEG5 | 6.6 | 20.4 | 15 | 9.5 | 9.8 | 6.3 | 18.4 | 3.6 | 1.4 | 1.6 |
| TEG6 | 14 | 19.4 | 34.1 | 24.2 | 693.1 | 1.1 | 10.8 | 27 | 27.8 | 28.4 |
| TEG7 | 803.3 | 1056 | 1122 | 1506 | 1453 | 737 | 773.1 | 2744 | 659.2 | 1021 |
| TEG8 | 1.2 | 1 | 2.5 | 5.4 | 5 | 4 | 0.9 | 4.8 | 1.2 | 2.1 |
| TEG9 | 6.1 | 32.9 | 46.2 | 64.1 | 8.5 | 52.2 | 101.9 | 22.8 | 15.1 | 3.7 |
| TEG10 | 10 | 298.6 | 458.4 | 948 | 1157 | 217.3 | 627.3 | 211.3 | 851.8 | 115.5 |
| TEG11 | 163.2 | 110.7 | 1211 | 425.5 | 343.5 | 2897 | 725.8 | 276 | 393.6 | 548.6 |
| TEG12 | 2 | 6.3 | 25.5 | 29.2 | 12.1 | 11.1 | 97.7 | 52.1 | 12.5 | 31.4 |
| TEG13 | 13.2 | 7.1 | 8.4 | 21.9 | 16.2 | 5.1 | 15.6 | 5.6 | 3.7 | 16.7 |
| TEG14 | 1404 | 387.7 | 562.1 | 522.3 | 657.9 | 633.3 | 338.9 | 524.7 | 508.2 | 861.9 |
| TEG15 | 112 | 7.1 | 9.1 | 41.4 | 204.1 | 0.9 | 21.6 | 6.7 | 4.7 | 7.2 |
| TEG16 | 42 | 0.9 | 5.7 | 66.8 | 53.1 | 25.3 | 12.4 | 38.8 | 0.4 | 7.6 |
| TEG17 | 72.9 | 225.2 | 104.8 | 44.5 | 30.4 | 83.4 | 77.6 | 69.2 | 28.2 | 127.6 |
| TEG18 | 34.4 | 49.3 | 137.8 | 325.4 | 40.5 | 68.1 | 189.7 | 160.9 | 243.1 | 321.3 |
| TEG19 | 82.1 | 190.7 | 41.8 | 27.6 | 72.4 | 53.4 | 15.9 | 131.1 | 277 | 19.9 |
| TEG20 | 7.3 | 39.4 | 5.4 | 4.5 | 18.1 | 20.5 | 48.1 | 2.3 | 12.5 | 8.5 |
| TEG21 | 7.4 | 6.4 | 13.4 | 16.5 | 7.4 | 3.6 | 14.6 | 3.6 | 4.8 | 11.9 |
| TEG22 | 25.5 | 28.2 | 98.9 | 17 | 32.5 | 68.9 | 62.6 | 68.1 | 46.9 | 57.2 |
| TEG23 | 4.5 | 2.5 | 8.4 | 1.5 | 11.5 | 19.1 | 8 | 412.2 | 35 | 21 |
| TEG24 | 9.4 | 8.7 | 1.3 | 1.5 | 14.7 | 7.6 | 20.3 | 1.7 | 3.2 | 4.1 |
| TEG25 | 11.7 | 0.5 | 31.3 | 112.9 | 0.7 | 30.1 | 6 | 7.9 | 856 | 52.8 |
| TEG26 | 13 | 3.3 | 32.5 | 2.6 | 5.5 | 11.8 | 1.1 | 1.4 | 11.6 | 4.3 |
| TEG27 | 221.3 | 39.4 | 44.1 | 40.6 | 32.4 | 86.3 | 66 | 44.7 | 11.3 | 36.6 |
| TEG28 | 76.3 | 102.5 | 4.2 | 51.2 | 116.5 | 75.2 | 33.8 | 17.9 | 26.3 | 48.2 |
| TEG29 | 103.5 | 16 | 77.6 | 204.9 | 183.8 | 101.5 | 31.1 | 233.1 | 8.4 | 131.8 |
| TEG30 | 124 | 39.7 | 27.7 | 151.6 | 41.4 | 115.7 | 51.3 | 67.9 | 32.2 | 9.3 |
| TEG31 | 17.2 | 2.3 | 27.7 | 31.3 | 3.6 | 14.5 | 9.8 | 17.8 | 17.6 | 3.8 |
| TEG32 | 27.3 | 664.5 | 3.5 | 4.2 | 160.6 | 8.5 | 811.5 | 20.4 | 10.1 | 4.3 |
| TEG33 | 33 | 46.3 | 14.7 | 53.1 | 45.2 | 25.4 | 5.5 | 28 | 4 | 3.8 |
| TEG34 | 110 | 177.5 | 261.7 | 191.4 | 81 | 58.2 | 155.9 | 246.1 | 145.6 | 86.3 |
| TEG35 | 0.9 | 55.8 | 129 | 3.2 | 0.9 | 0.7 | 153.5 | 264.7 | 3.1 | 1 |
| TEG36 | 5.6 | 24.5 | 2 | 15.1 | 0.7 | 2 | 12.2 | 1.8 | 13.5 | 0.8 |
| TEG37 | 76.8 | 48.2 | 2.6 | 101.7 | 1.9 | 121 | 57.3 | 15.3 | 93.8 | 53.4 |
| TEG38 | 96.2 | 287.7 | 915 | 1308 | 173 | 331.3 | 1125 | 1101 | 2124 | 1106 |
| TEG39 | 5.3 | 24 | 66.7 | 27.8 | 34.7 | 174.1 | 32.4 | 47.3 | 20.3 | 41.9 |
| TEG40 | 208.7 | 290.4 | 148.5 | 272.2 | 2277 | 229.8 | 263.4 | 154.5 | 161.8 | 216.7 |
| TEG41 | 35.5 | 63.6 | 16.7 | 5.8 | 12.3 | 9.7 | 7.1 | 29 | 24.4 | 16.7 |
| TEG42 | 2572 | 224.8 | 1238 | 227.6 | 1359 | 1205 | 1181 | 1759 | 666.7 | 582.9 |
| TEG43 | 83.4 | 27.5 | 139.6 | 37 | 81 | 347.7 | 83.5 | 55.4 | 13.5 | 98.7 |
| TEG44 | 272.3 | 7.2 | 68 | 73.9 | 67.5 | 62.5 | 85.2 | 24.4 | 5.6 | 278 |
| TEG45 | 45.5 | 127.6 | 174.6 | 91.8 | 119.5 | 287.7 | 150.7 | 188.9 | 204.5 | 237.7 |
| TEG46 | 92.6 | 70.3 | 27.2 | 40.8 | 26.9 | 32.3 | 9.9 | 17.1 | 15.1 | 18.1 |
| TEG47 | 14.7 | 27.4 | 109.2 | 15.3 | 109.8 | 898.5 | 6.6 | 9.5 | 20.2 | 0.6 |
| TEG48 | 52.2 | 183.3 | 34.7 | 49.1 | 165.1 | 61.5 | 64.1 | 39.5 | 29.3 | 42 |
| TEG49 | 244.9 | 1056 | 401.8 | 378.8 | 518.9 | 434.6 | 558.9 | 492.7 | 509.6 | 462.7 |
| TEG50 | 73 | 55.1 | 17.9 | 39 | 54.6 | 38.9 | 12.4 | 17.2 | 41.5 | 25.9 |
| TEG51 | 390 | 271.2 | 337.4 | 520.9 | 417.6 | 252.4 | 231.8 | 465.3 | 128 | 319.3 |
| TEG52 | 46.9 | 1048 | 16.1 | 38.3 | 231.1 | 14.7 | 15.9 | 158.4 | 7.9 | 31.2 |
| TEG53 | 12.6 | 16.6 | 51.1 | 5.1 | 69.5 | 47.3 | 3.6 | 16.6 | 14.6 | 27.5 |
| TEG54 | 864.1 | 4 | 123.8 | 302.6 | 72.3 | 116.3 | 295.1 | 109.7 | 322 | 129 |
| TEG55 | 293 | 574.2 | 73.2 | 139.4 | 123.6 | 65.4 | 48.2 | 6.8 | 159.5 | 24 |
| TEG56 | 11.7 | 3.5 | 373.8 | 58.3 | 29.5 | 1102 | 104.7 | 47.1 | 94.7 | 134.1 |
| TEG57 | 90.6 | 43 | 71.8 | 67.4 | 418.8 | 64.9 | 15 | 2.6 | 118.5 | 35.9 |
| TEG58 | 5.8 | 20.5 | 4.3 | 17.3 | 5.5 | 2 | 128 | 12.7 | 25.8 | 7.8 |
| TEG59 | 617.5 | 454.7 | 354.1 | 922.7 | 710 | 328.3 | 299 | 1023 | 515.7 | 271.8 |
| TEG60 | 111.8 | 2.6 | 42.1 | 16.3 | 40.8 | 23.7 | 27 | 9.6 | 12.1 | 1.4 |
| TEG61 | 0.7 | 2.5 | 3.7 | 2 | 3 | 0.5 | 1.4 | 8.9 | 2.4 | 0.8 |
| TEG62 | 9.8 | 23.7 | 21.8 | 28 | 23 | 14.5 | 10.2 | 13 | 9.4 | 23 |
| TEG63 | 7.5 | 37.6 | 6.7 | 16 | 28.9 | 19.8 | 32.6 | 5.9 | 1.8 | 12.6 |
| TEG64 | 112.9 | 30.1 | 46.2 | 31 | 32.5 | 77.4 | 5.9 | 8.5 | 3.6 | 48.6 |

| No | Lung small cell lung cancer 21 | Lung small cell lung cancer 22 | Pancreatic cancer 1 | Pancreatic cancer 2 | Pancreatic cancer 3 | Pancreatic cancer 4 | Pancreatic cancer 5 | Pancreatic cancer 6 | Pancreatic cancer 7 | Pancreatic cancer 8 |
|---|---|---|---|---|---|---|---|---|---|---|
| TEG1 | 51.9 | 3.4 | 56.4 | 83.2 | 64.6 | 10.1 | 10.2 | 13.1 | 7.9 | 9.4 |
| TEG2 | 28.5 | 460.8 | 7.6 | 7.6 | 14.8 | 84.6 | 103.7 | 24.3 | 3.7 | 24.3 |
| TEG3 | 81.8 | 144.8 | 40.2 | 123.6 | 72.1 | 32.9 | 60 | 93.7 | 39.4 | 61.3 |
| TEG4 | 0.5 | 23.4 | 8 | 21.6 | 10.6 | 35.2 | 13.5 | 28.1 | 23 | 17.4 |
| TEG5 | 14.8 | 15.4 | 19.3 | 30.4 | 19.5 | 57.9 | 31 | 24.7 | 37.3 | 4.9 |
| TEG6 | 8.1 | 37.7 | 60.7 | 11.4 | 57.9 | 81.5 | 53.9 | 63.8 | 71.5 | 78.3 |
| TEG7 | 220.8 | 1304 | 624.8 | 384.3 | 597.7 | 300.2 | 596.9 | 328.6 | 497.5 | 161.4 |
| TEG8 | 8.4 | 7.9 | 14.7 | 19.8 | 10.9 | 31 | 27.6 | 21.5 | 23.2 | 20.6 |
| TEG9 | 29.5 | 50.6 | 29.9 | 234.4 | 20.6 | 25.4 | 21.8 | 37.4 | 267.9 | 176.2 |
| TEG10 | 179 | 61.3 | 47.9 | 136 | 47.9 | 10.9 | 231.9 | 125.4 | 42.1 | 118.5 |
| TEG11 | 604.3 | 369.7 | 411.3 | 1276 | 414.7 | 44.6 | 141.8 | 847.8 | 338 | 674.6 |
| TEG12 | 8.2 | 27.4 | 14.7 | 17.3 | 26.2 | 9.8 | 28 | 17.2 | 18.3 | 20.5 |
| TEG13 | 17.1 | 19.7 | 15.2 | 25.2 | 5.1 | 24.6 | 19.8 | 21.2 | 9.8 | 27.9 |
| TEG14 | 381.2 | 923.8 | 81.1 | 89 | 97.9 | 48.4 | 71.4 | 67.4 | 111.3 | 15.2 |
| TEG15 | 65.9 | 58.2 | 2.7 | 88.9 | 5.8 | 43.3 | 48.5 | 21.6 | 68.7 | 60.5 |

TABLE 4-continued

| | | | | | | | | | | |
|---|---|---|---|---|---|---|---|---|---|---|
| TEG16 | 1.2 | 10.3 | 5.4 | 14.2 | 5.4 | 5.1 | 6 | 10 | 7.2 | 5.6 |
| TEG17 | 166.3 | 9.3 | 4.7 | 2.9 | 21.2 | 93.1 | 66.4 | 18.1 | 6.5 | 77.3 |
| TEG18 | 270.5 | 148.8 | 680.1 | 484.1 | 80.2 | 14.4 | 63.1 | 472.8 | 140.7 | 671.8 |
| TEG19 | 118.2 | 21.4 | 1.8 | 2.2 | 101.5 | 7.5 | 2.9 | 4.6 | 2.4 | 6.2 |
| TEG20 | 18.3 | 1.5 | 11.5 | 10 | 10.6 | 11.7 | 11.6 | 11.4 | 7.4 | 13.6 |
| TEG21 | 13.8 | 3.4 | 7.3 | 12.2 | 3.1 | 10.8 | 10.1 | 11.9 | 7.1 | 17.4 |
| TEG22 | 43.4 | 83.4 | 89 | 72.4 | 41.6 | 54.5 | 59.3 | 63.8 | 43.8 | 95.9 |
| TEG23 | 0.5 | 30.1 | 7.5 | 18.4 | 3.7 | 21.7 | 18.7 | 17.6 | 24.4 | 50.2 |
| TEG24 | 7.4 | 19.7 | 33 | 12 | 12.5 | 61.8 | 3.9 | 6.9 | 16.6 | 15.9 |
| TEG25 | 13.2 | 14.3 | 19.7 | 63.6 | 8.3 | 59.7 | 80.7 | 85.8 | 13.1 | 599.6 |
| TEG26 | 8.9 | 21.1 | 31.6 | 61.6 | 82.9 | 295.7 | 142.6 | 34.9 | 34.1 | 37.5 |
| TEG27 | 56.8 | 13.1 | 92.8 | 136.1 | 47.8 | 32.6 | 60.6 | 45.2 | 63.7 | 5.4 |
| TEG28 | 10.3 | 22 | 80.2 | 108.9 | 198 | 85.3 | 320.3 | 54.6 | 141.8 | 56.1 |
| TEG29 | 446.5 | 63.9 | 11.9 | 23.2 | 111.4 | 1.3 | 0.3 | 2.7 | 496.7 | 80.4 |
| TEG30 | 42.6 | 145.6 | 30.1 | 307.8 | 51.1 | 10.1 | 52.5 | 220.4 | 105.9 | 91.3 |
| TEG31 | 94.9 | 15.7 | 71.8 | 17.6 | 191.4 | 17.3 | 15.1 | 83 | 6.8 | 13 |
| TEG32 | 99.8 | 16.3 | 1099 | 678.1 | 434.7 | 298.9 | 357.7 | 158.7 | 851.7 | 542.1 |
| TEG33 | 37.2 | 4.5 | 121.4 | 149.4 | 141.4 | 199.9 | 166.4 | 142.4 | 119.8 | 173.9 |
| TEG34 | 134.6 | 189.4 | 429.1 | 258.2 | 212.2 | 237.6 | 337.5 | 150.9 | 424.2 | 500.5 |
| TEG35 | 3.1 | 54.5 | 2.6 | 2.6 | 3.1 | 2 | 335.9 | 3.5 | 2.5 | 3 |
| TEG36 | 13.1 | 11.7 | 53.6 | 97.2 | 49.4 | 198.6 | 274.3 | 60.8 | 36.8 | 90.2 |
| TEG37 | 40.3 | 1.7 | 101.9 | 65.2 | 71.2 | 184.4 | 11.2 | 35.6 | 58.7 | 41.5 |
| TEG38 | 871.1 | 548.6 | 3455 | 3398 | 606.2 | 212.9 | 1687 | 4892 | 2485 | 4082 |
| TEG39 | 93.3 | 44 | 222 | 287.3 | 210.7 | 1982 | 513.9 | 379.9 | 537.9 | 176.3 |
| TEG40 | 147.9 | 248.6 | 255.1 | 521.1 | 373 | 538 | 502.1 | 311.5 | 465.5 | 468.4 |
| TEG41 | 25.4 | 3.9 | 179.8 | 89.1 | 85.8 | 153.4 | 377.6 | 75.7 | 113.1 | 71.8 |
| TEG42 | 850.4 | 637.9 | 797.9 | 511.9 | 725.9 | 928.1 | 1052 | 361.5 | 1671 | 1923 |
| TEG43 | 108.9 | 65.2 | 152 | 697.5 | 80.7 | 24.9 | 24.6 | 321.8 | 24.5 | 118.5 |
| TEG44 | 18.7 | 191.5 | 2.7 | 2.8 | 3.2 | 3.2 | 4.2 | 3.1 | 3.6 | 6.5 |
| TEG45 | 245.5 | 314.9 | 48.5 | 123.2 | 78.1 | 23.4 | 55.3 | 290.1 | 116.7 | 95.9 |
| TEG46 | 25.1 | 34.5 | 25.7 | 46.9 | 22.8 | 12.3 | 42.2 | 14.2 | 14.9 | 33.1 |
| TEG47 | 2.1 | 11.1 | 2.8 | 52.1 | 53.1 | 4.4 | 3.6 | 137.4 | 2.9 | 61 |
| TEG48 | 163 | 65.4 | 135.4 | 257.4 | 316.4 | 109.9 | 415.3 | 128.1 | 393.5 | 198 |
| TEG49 | 477.7 | 323.5 | 355.6 | 675.3 | 754 | 421.9 | 835 | 323.8 | 552.7 | 349.6 |
| TEG50 | 31.6 | 59.3 | 78.7 | 123.1 | 168.1 | 253.1 | 139.6 | 53.6 | 184.3 | 85.4 |
| TEG51 | 210.7 | 468 | 340.6 | 237.3 | 415 | 147.2 | 182.8 | 98.9 | 282.4 | 98.4 |
| TEG52 | 127.8 | 37.4 | 460.8 | 524.9 | 252.9 | 14.1 | 6.5 | 881.5 | 432.1 | 29.4 |
| TEG53 | 7.1 | 27.6 | 103.6 | 141.6 | 94.1 | 9.5 | 39.7 | 73.8 | 62.9 | 48.4 |
| TEG54 | 97.2 | 194.3 | 25.2 | 34.2 | 2.4 | 165 | 192.9 | 1.7 | 31.1 | 44.4 |
| TEG55 | 54.5 | 8.4 | 800.1 | 472.9 | 669.8 | 411.9 | 392.2 | 318.3 | 604.2 | 436.5 |
| TEG56 | 127.6 | 31.4 | 142.7 | 94.1 | 67.4 | 51.6 | 63 | 207.8 | 51.5 | 345.8 |
| TEG57 | 27.8 | 13.3 | 25.9 | 38.5 | 5.8 | 26.9 | 9.5 | 5.1 | 34.4 | 33.3 |
| TEG58 | 6.6 | 13.9 | 16.3 | 13.9 | 20.9 | 6.6 | 13.9 | 32 | 9.3 | 29.6 |
| TEG59 | 364.7 | 375.2 | 337.2 | 561.8 | 688.7 | 117.2 | 353.2 | 185.3 | 527.3 | 69.7 |
| TEG60 | 15.2 | 20.8 | 38.8 | 30.9 | 28.1 | 52.7 | 84.8 | 26.4 | 27.1 | 13.7 |
| TEG61 | 10.1 | 1 | 3.2 | 4.6 | 229.9 | 2.7 | 1.9 | 7.7 | 5.9 | 4.8 |
| TEG62 | 154.3 | 42.2 | 216.9 | 110.7 | 148.8 | 189.5 | 44.9 | 168.1 | 232.3 | 36.8 |
| TEG63 | 21.8 | 32.7 | 31.7 | 35.2 | 60.1 | 29.5 | 32.6 | 65.5 | 35.3 | 32 |
| TEG64 | 31.2 | 26.5 | 7 | 6 | 4.5 | 12 | 44.9 | 9.7 | 12.4 | 7.6 |

| No | Pancreatic cancer 9 | Pancreatic cancer 10 | Pancreatic cancer 11 | Pancreatic cancer 12 | Pancreatic cancer 13 | Pancreatic cancer 14 | Pancreatic cancer 15 | Pancreatic cancer 16 | Pancreatic cancer 17 | Pancreatic cancer 18 |
|---|---|---|---|---|---|---|---|---|---|---|
| TEG1 | 6.6 | 8.7 | 13.6 | 5.6 | 94 | 8.9 | 25.4 | 111 | 8.5 | 3.7 |
| TEG2 | 14.3 | 41.4 | 209.5 | 43.8 | 16.5 | 35.5 | 9.1 | 7.8 | 10 | 11.6 |
| TEG3 | 254.7 | 142.8 | 102.4 | 46.4 | 104 | 79.1 | 51.3 | 258.5 | 170 | 45.9 |
| TEG4 | 8.6 | 52.8 | 28.1 | 18.3 | 67.2 | 19.8 | 14.7 | 11.9 | 14.2 | 14.4 |
| TEG5 | 33.3 | 31.7 | 32.6 | 20.1 | 12 | 36.9 | 33.2 | 28.4 | 56 | 15.9 |
| TEG6 | 75.3 | 66.9 | 38.2 | 89.8 | 45.2 | 91.4 | 68.2 | 43.2 | 46.5 | 58 |
| TEG7 | 360.7 | 340.7 | 331.1 | 108.6 | 255 | 775.5 | 67.7 | 388.5 | 401.2 | 677.6 |
| TEG8 | 6.9 | 10.1 | 17.8 | 22 | 17.3 | 94 | 13.7 | 24 | 36.5 | 19.6 |
| TEG9 | 187.5 | 206.7 | 70.9 | 74.3 | 122 | 103 | 431 | 67.2 | 265 | 108.9 |
| TEG10 | 152.3 | 68 | 72.7 | 51 | 56.3 | 37.5 | 43.4 | 135.2 | 35 | 20.7 |
| TEG11 | 1533 | 1582 | 973.6 | 279.3 | 931.4 | 168 | 125.4 | 647.2 | 1786 | 646.5 |
| TEG12 | 28.2 | 17 | 20.7 | 10.3 | 11.6 | 33.1 | 5.2 | 18.3 | 7.8 | 14.2 |
| TEG13 | 11.5 | 18.1 | 15.3 | 13.5 | 29.8 | 17.2 | 4.8 | 4.9 | 5.6 | 12.4 |
| TEG14 | 89.3 | 98.6 | 135.9 | 3.2 | 65.5 | 209.4 | 5.4 | 90.3 | 12.8 | 26.7 |
| TEG15 | 78.1 | 44.6 | 74.9 | 73.4 | 43.1 | 159.7 | 13.6 | 27.5 | 50.5 | 50.2 |
| TEG16 | 127.2 | 10.6 | 5.7 | 7.2 | 5.6 | 6.9 | 5.7 | 10.1 | 23.9 | 2.4 |
| TEG17 | 3.4 | 50 | 27.3 | 58.5 | 6.6 | 22.8 | 16 | 67.1 | 50 | 24.7 |
| TEG18 | 292.2 | 1607 | 142.8 | 57.8 | 108.1 | 230.9 | 217 | 737.1 | 833.7 | 725.6 |
| TEG19 | 4 | 2.5 | 111.7 | 6.7 | 5.3 | 5.2 | 18.3 | 4.8 | 159.2 | 3.3 |
| TEG20 | 53.1 | 6.6 | 64.3 | 12.5 | 29.5 | 12.3 | 14.7 | 150.4 | 166.1 | 40.2 |
| TEG21 | 15.2 | 19 | 16.4 | 7.2 | 15.1 | 8.7 | 3.1 | 32.3 | 9.5 | 2 |
| TEG22 | 55.5 | 51.1 | 45.5 | 35 | 91.4 | 66.4 | 70.7 | 84.6 | 60.3 | 27.6 |
| TEG23 | 23.7 | 23.3 | 22.7 | 26.3 | 22.8 | 18.5 | 21.8 | 20.9 | 18.2 | 16.1 |
| TEG24 | 28.1 | 20.7 | 110.8 | 26.3 | 39 | 32.9 | 27.8 | 18.1 | 11.4 | 12.1 |
| TEG25 | 12.9 | 19.5 | 33.8 | 45.4 | 27.6 | 469.7 | 35.3 | 20.8 | 35 | 19.8 |
| TEG26 | 138.2 | 129.4 | 74.3 | 72.5 | 134.4 | 89.6 | 56.1 | 403.7 | 64 | 305.2 |

TABLE 4-continued

| | | | | | | | | | |
|---|---|---|---|---|---|---|---|---|---|
| TEG27 | 42.5 | 46.1 | 50.8 | 18.9 | 44.1 | 2.5 | 31.1 | 33.4 | 57.3 | 14.9 |
| TEG28 | 61 | 127 | 164.4 | 82.1 | 93.1 | 60.1 | 40.4 | 140.4 | 207.8 | 217.7 |
| TEG29 | 92.3 | 122.9 | 17.5 | 9.9 | 159.9 | 12.1 | 92.6 | 0.9 | 6.9 | 6.5 |
| TEG30 | 172.2 | 81.7 | 264.9 | 35.7 | 42.2 | 42.8 | 26.4 | 33.9 | 10.6 | 33.7 |
| TEG31 | 42.1 | 10.8 | 123.1 | 12.8 | 94.7 | 14.5 | 40.5 | 17.5 | 167.3 | 170.6 |
| TEG32 | 603.7 | 365.8 | 1524 | 754 | 365.5 | 1140 | 119.7 | 2518 | 286.8 | 347.2 |
| TEG33 | 108.1 | 123.9 | 131.9 | 127.3 | 150.2 | 136.8 | 170 | 149.7 | 133.8 | 105.5 |
| TEG34 | 192.1 | 535.3 | 214.9 | 236.7 | 263.9 | 341.3 | 79.4 | 449.6 | 149.1 | 254.6 |
| TEG35 | 1.2 | 2.4 | 2.8 | 1.6 | 1.6 | 60.1 | 3.4 | 1.5 | 2.1 | 3.3 |
| TEG36 | 138 | 57.1 | 79.3 | 106.8 | 80.9 | 6.5 | 31.5 | 154.5 | 454.6 | 359.7 |
| TEG37 | 63.7 | 48.2 | 54.7 | 59 | 69 | 1.6 | 85.9 | 191.6 | 247.3 | 59.8 |
| TEG38 | 2148 | 3866 | 2351 | 898 | 1415 | 2198 | 2109 | 2654 | 7348 | 8196 |
| TEG39 | 422.7 | 859.1 | 199.8 | 1050 | 551.8 | 83.4 | 154.8 | 363.7 | 479.2 | 1840 |
| TEG40 | 349.2 | 149.9 | 605.7 | 466.4 | 818.3 | 301.3 | 419.8 | 344.7 | 331.6 | 416.8 |
| TEG41 | 140.6 | 97 | 156 | 38.7 | 201.3 | 111.1 | 86.2 | 184 | 132.5 | 189.1 |
| TEG42 | 671 | 716.5 | 341.8 | 736.2 | 752.3 | 608.1 | 817.9 | 864.9 | 505.5 | 347.7 |
| TEG43 | 248.8 | 368.1 | 401.7 | 1357 | 108.4 | 31.3 | 24.4 | 185.7 | 66 | 64.4 |
| TEG44 | 3.5 | 2.7 | 2.2 | 3.6 | 2.8 | 1.9 | 44.6 | 3.4 | 1.8 | 2.7 |
| TEG45 | 215 | 220.2 | 117.5 | 46.4 | 53.5 | 80.3 | 67 | 146.2 | 85.6 | 24.5 |
| TEG46 | 31.4 | 19.4 | 36.4 | 45.9 | 16.5 | 38.5 | 6.3 | 30.9 | 37.6 | 25.8 |
| TEG47 | 41.2 | 21.6 | 28.7 | 10.9 | 25.8 | 2.5 | 11.8 | 203.1 | 129.7 | 24.3 |
| TEG48 | 168.4 | 216 | 239.2 | 274.2 | 305.5 | 163.2 | 60.4 | 64.4 | 327.7 | 191.4 |
| TEG49 | 472.1 | 603.5 | 462.9 | 610.7 | 289.5 | 463.9 | 382.2 | 245 | 162.3 | 188.5 |
| TEG50 | 105.7 | 70 | 87.9 | 202.7 | 97.5 | 132.7 | 75.3 | 222.7 | 276.7 | 334 |
| TEG51 | 290.2 | 276 | 539.1 | 46.9 | 310 | 200.9 | 10.5 | 125 | 90.1 | 123.3 |
| TEG52 | 584 | 154.4 | 137.4 | 65.1 | 249.1 | 71.3 | 12.3 | 219.7 | 769 | 210.9 |
| TEG53 | 144.3 | 32 | 90.7 | 9.5 | 67.7 | 6.9 | 54.8 | 30.6 | 44.6 | 18 |
| TEG54 | 13.1 | 27.6 | 27.7 | 37 | 146.6 | 2.1 | 86 | 29.4 | 58.7 | 33.1 |
| TEG55 | 331 | 426 | 244.4 | 200.9 | 586.8 | 228.8 | 228.6 | 455.8 | 645.7 | 890.2 |
| TEG56 | 153.2 | 371.7 | 70.9 | 190 | 128.2 | 124.6 | 443.2 | 290.9 | 257.3 | 217.9 |
| TEG57 | 11.8 | 17.2 | 17.1 | 8.4 | 8.4 | 32.1 | 37.2 | 44.9 | 46.2 | 19.6 |
| TEG58 | 16.5 | 13 | 28 | 11 | 24.7 | 24 | 13.6 | 14.4 | 8.9 | 5 |
| TEG59 | 515.5 | 425 | 985.1 | 79.8 | 467.3 | 906.8 | 70 | 369.5 | 351.9 | 479.5 |
| TEG60 | 8.9 | 27 | 50.3 | 20.6 | 34.4 | 50 | 29.4 | 33 | 18.5 | 20.4 |
| TEG61 | 5.3 | 5 | 6.3 | 4.5 | 2.7 | 5.4 | 2.9 | 5.2 | 88.7 | 2.1 |
| TEG62 | 63.4 | 128.9 | 210.9 | 176.5 | 196.1 | 562.2 | 51 | 144.3 | 164.7 | 249.9 |
| TEG63 | 45.5 | 25.2 | 47 | 35.4 | 33.3 | 7.1 | 62.3 | 33.2 | 27.3 | 25.9 |
| TEG64 | 12.9 | 12.4 | 42.1 | 20.2 | 11 | 15.2 | 11.5 | 48.8 | 38.9 | 54.6 |

| No | Pancreatic cancer 19 | Pancreatic cancer 20 | Pancreatic cancer 21 | Pancreatic cancer 22 | Pancreatic cancer 23 | Pancreatic cancer 24 | Pancreatic cancer 25 | Pancreatic cancer 26 | Pancreatic cancer 27 |
|---|---|---|---|---|---|---|---|---|---|
| TEG1 | 44.8 | 5.6 | 59.1 | 143.6 | 103 | 61 | 195.4 | 218.7 | 43.4 |
| TEG2 | 533.3 | 1.3 | 30.2 | 87.7 | 19.1 | 35.5 | 33.9 | 22.9 | 5.8 |
| TEG3 | 18.3 | 54.3 | 14.5 | 42.6 | 37 | 50 | 83.2 | 35.8 | 45.3 |
| TEG4 | 14.7 | 14.8 | 10.4 | 12.3 | 7.1 | 8.5 | 12.9 | 24.9 | 10.8 |
| TEG5 | 20.1 | 32.3 | 13.9 | 3 | 36 | 20.4 | 23.2 | 26.9 | 29.3 |
| TEG6 | 84.5 | 56.1 | 42.1 | 30.1 | 31.1 | 53.7 | 72.1 | 10.2 | 68.9 |
| TEG7 | 502.5 | 421.1 | 656.4 | 511.9 | 470.4 | 226.7 | 221.1 | 360.8 | 95.7 |
| TEG8 | 17.6 | 6.5 | 11.5 | 2.7 | 4.2 | 4.8 | 5.5 | 21.5 | 10.8 |
| TEG9 | 180.2 | 59.6 | 141.4 | 183.9 | 78.9 | 68.8 | 216.7 | 353.4 | 427.8 |
| TEG10 | 10.4 | 36.2 | 66.9 | 30.7 | 20.9 | 30 | 48.6 | 57.7 | 19.2 |
| TEG11 | 26.4 | 2369 | 819 | 1724 | 551.3 | 1336 | 685.6 | 908.3 | 185.8 |
| TEG12 | 12.9 | 21.9 | 2.5 | 11.4 | 19 | 7.3 | 13.9 | 15.2 | 8.8 |
| TEG13 | 11.5 | 42.1 | 9.3 | 10.7 | 8.2 | 9.6 | 8.9 | 21.1 | 23.6 |
| TEG14 | 59.4 | 29.8 | 12.7 | 25.1 | 34.1 | 19.1 | 14.2 | 21 | 4.6 |
| TEG15 | 120.7 | 49.5 | 80.8 | 29.6 | 22.5 | 71.9 | 31.6 | 24.6 | 19.8 |
| TEG16 | 4.9 | 5.9 | 2.5 | 3.9 | 4.4 | 3.9 | 41.7 | 8.5 | 5.5 |
| TEG17 | 91 | 19.8 | 31.7 | 2.5 | 67.2 | 54 | 5.3 | 37.7 | 10.2 |
| TEG18 | 201 | 197.8 | 594.3 | 388.4 | 67.3 | 239.6 | 21.4 | 113.8 | 103.6 |
| TEG19 | 2 | 3.5 | 3 | 3.1 | 21.1 | 22.2 | 46.1 | 9 | 34.8 |
| TEG20 | 35 | 35.6 | 67.1 | 25.5 | 11.4 | 36.9 | 28 | 10.1 | 27.1 |
| TEG21 | 1.8 | 11.2 | 1.4 | 5.4 | 10.3 | 3.2 | 8.6 | 2.4 | 9.8 |
| TEG22 | 33.7 | 24.3 | 26.6 | 29.6 | 18.3 | 22.7 | 37.1 | 42.7 | 38.4 |
| TEG23 | 2.8 | 14.1 | 14.6 | 2 | 2 | 1.5 | 14.4 | 5.3 | 6.6 |
| TEG24 | 70.8 | 30.8 | 26 | 8.2 | 19.3 | 1.9 | 22 | 15 | 28 |
| TEG25 | 54.4 | 8.4 | 24.9 | 10.1 | 20.8 | 11.3 | 26.3 | 10.8 | 2 |
| TEG26 | 22.8 | 53.7 | 36.6 | 47.7 | 646 | 21.8 | 46.4 | 130.5 | 56 |
| TEG27 | 53.4 | 26.6 | 35.1 | 26.1 | 44.4 | 39.5 | 26.7 | 71.8 | 66.9 |
| TEG28 | 130 | 58.5 | 84.9 | 213.6 | 229.1 | 119 | 173.6 | 223 | 105.1 |
| TEG29 | 1.1 | 20.5 | 10.6 | 20.6 | 6.9 | 10.5 | 15.3 | 1.1 | 11.5 |
| TEG30 | 149.8 | 43 | 467.6 | 41.5 | 33.3 | 27.1 | 409.3 | 65.9 | 37.5 |
| TEG31 | 10.1 | 218.3 | 64.6 | 11.7 | 440.6 | 15.6 | 592.3 | 11.4 | 50.3 |
| TEG32 | 819.2 | 260.5 | 962.9 | 467.3 | 530.8 | 315.6 | 345.4 | 231.8 | 155 |
| TEG33 | 117.6 | 112.2 | 96.1 | 109.9 | 91.7 | 89.7 | 85.8 | 81.6 | 110.9 |
| TEG34 | 272.2 | 61.1 | 109.4 | 116.3 | 214.9 | 148 | 264.2 | 455.4 | 56.4 |
| TEG35 | 1.9 | 1.7 | 2.5 | 1.8 | 1.3 | 2 | 2.2 | 3.8 | 3.4 |
| TEG36 | 656.7 | 127 | 481.7 | 221.5 | 315.8 | 27.7 | 57 | 50.3 | 3.6 |
| TEG37 | 121 | 189.2 | 20 | 60.3 | 96.4 | 47.1 | 135.3 | 128.1 | 70.2 |

TABLE 4-continued

| | | | | | | | | | |
|---|---|---|---|---|---|---|---|---|---|
| TEG38 | 2388 | 5458 | 8096 | 6858 | 2328 | 4897 | 1018 | 3735 | 1340 |
| TEG39 | 127.8 | 565.5 | 209 | 345.6 | 810.7 | 205.4 | 275.1 | 385.1 | 278.3 |
| TEG40 | 913.7 | 513.4 | 528.4 | 195.9 | 346 | 250.4 | 300.4 | 337.1 | 637.9 |
| TEG41 | 82.3 | 71.3 | 260.5 | 130.4 | 339.3 | 70.7 | 111.3 | 188.1 | 41.6 |
| TEG42 | 949.8 | 208.4 | 329.2 | 293.8 | 449.2 | 616.4 | 182 | 484.3 | 515.6 |
| TEG43 | 234.4 | 811.7 | 288.3 | 253.1 | 436 | 214.1 | 53.8 | 49.6 | 25.5 |
| TEG44 | 3.2 | 10.6 | 1.4 | 6 | 2.4 | 1.5 | 2.4 | 20.9 | 27.5 |
| TEG45 | 10.7 | 78.5 | 97.6 | 29.3 | 75.2 | 107.3 | 74.5 | 139.3 | 83.1 |
| TEG46 | 42.7 | 35.4 | 18.3 | 30.8 | 13 | 57.9 | 28.4 | 18.9 | 19 |
| TEG47 | 39.4 | 126.4 | 19.6 | 54.6 | 92.5 | 58.9 | 38.5 | 250.5 | 3.6 |
| TEG48 | 253.2 | 294.9 | 240.7 | 378.3 | 295.8 | 208.2 | 142.2 | 361.7 | 41.5 |
| TEG49 | 439 | 229.4 | 194.3 | 274.1 | 343.6 | 246.7 | 252.2 | 285.9 | 130.2 |
| TEG50 | 538.3 | 115.4 | 133.4 | 114.2 | 129.1 | 76.2 | 153.2 | 81.7 | 99 |
| TEG51 | 52 | 176.6 | 91.9 | 179 | 47.1 | 62.8 | 69.2 | 49.4 | 5.5 |
| TEG52 | 251.6 | 252 | 1128 | 236.4 | 772.2 | 211.6 | 274.9 | 1141 | 7.3 |
| TEG53 | 23.2 | 104 | 36.4 | 11.5 | 35.3 | 24.2 | 33 | 50.2 | 27 |
| TEG54 | 175.4 | 90.6 | 80.9 | 174.9 | 135.9 | 27.9 | 58.6 | 194.5 | 163.6 |
| TEG55 | 796 | 374.7 | 469.6 | 634.5 | 1066 | 167.1 | 539.2 | 756.3 | 162.7 |
| TEG56 | 5.3 | 976.2 | 294.4 | 160.7 | 546.2 | 839.1 | 574.4 | 122.6 | 363.6 |
| TEG57 | 75.3 | 7.6 | 36.1 | 43.9 | 21.2 | 37.8 | 33.5 | 73.3 | 82 |
| TEG58 | 8.3 | 13.4 | 2.8 | 2.9 | 19.4 | 13.3 | 11.3 | 8.6 | 40.1 |
| TEG59 | 355.6 | 152.6 | 266.9 | 332.8 | 211.1 | 132.9 | 86.8 | 217.2 | 32 |
| TEG60 | 8.1 | 40.9 | 37.6 | 32.2 | 27.9 | 25.3 | 24.2 | 8.6 | 3.3 |
| TEG61 | 3.6 | 6 | 1.2 | 2.2 | 256.1 | 3.7 | 3.7 | 3.9 | 3.9 |
| TEG62 | 40.1 | 75 | 92.6 | 157.2 | 143.5 | 67.5 | 18 | 82.2 | 24 |
| TEG63 | 33.4 | 24 | 13.5 | 11.4 | 13.3 | 16.7 | 19.6 | 15.4 | 35.9 |
| TEG64 | 27.2 | 17.3 | 5.7 | 36 | 30.2 | 14.1 | 41 | 4.6 | 6.1 |

Example 2

Study of Frequency of Expression Elevation Using RT-PCR

In the above-mentioned Gene chip analysis, RNA prepared from each type of excised cancer tissue was analyzed as a whole. In order to verify the results from the Gene chip analysis, mRNA expression level of each gene in the respective cancer samples and the normal tissue in the non-cancerous part was analyzed by the RT-PCR method to examine the degree of expression elevation and the frequency of expression elevation.

2.1. Preparation of Single-stranded cDNA from Each Type of Cancer Tissue

From each type of human cancer tissue and normal tissue, a single-stranded cDNA to be used as a template DNA in the PCR was prepared as follows.

Total RNA was prepared in the same manner as described above from 12 cases of lung adenocarcinoma tissue and 4 cases of normal lung tissue for lung adenocarcinoma, 10 cases of human large bowel cancer tissue and normal large bowel tissue in non-cancerous part of the same excised tissue for human large bowel cancer, 12 cases of excised human stomach cancer tissue and normal stomach tissue in non-cancerous part of the same excised tissue for human stomach cancer, and 9 cases of excised human liver cancer tissue and non-cancerous part of the same excised tissue for human liver cancer, respectively. Single-stranded cDNA was synthesized from the total RNA using a reverse transcriptase Superscript II (manufactured by GIBCO BRL). The single-stranded cDNA prepared in this manner was used as a template DNA in PCR described below.

2.2 Expression Analysis by RT-PCR

Subsequently, the expression level of mRNA corresponding to the genes shown in Table 2 was analyzed by the RT-PCR method. More specifically, 25 μL of a PCR solution was prepared containing 500 mM KCl, 100 mM Tris-HCl (pH 8.3), 20 mM $MgCl_2$, 0.1% gelatin, 1.25 mM of each dNTPs (dATP, dCTP, dGTP, dTTP), 1 μL of single-stranded cDNA, a set of sense and antisense primers that are specific for each gene in an amount of 5 pmole each, 0.75 μL of SYBR Green I (1000-fold diluted solution, manufactured by TAKARA) and 0.25 μL of recombinant Taq polymerase Mix (FG Pluthero, Rapid purification of high-activity Taq DNA polymerase, Nucl. Acids. Res. 1993 21: 4850-4851). The reaction consisted of initial denaturation at 94° C. for 3 minutes, and 30 cycles of 94° C. for 15 seconds, 57° C. for 15 seconds and 72° C. for 30 seconds. RT-PCR primers shown in Table 5 were designed and used in the analysis.

In addition, the expression level of human β-actin gene in each RNA was also analyzed in the same manner as described above using a sense primer (SEQ ID NO: 252: AGAAG-GAGATCACTGCCCTGGCACC) and an antisense primer (SEQ ID NO: 253: CCTGCTTGCTGATCCACATCT-GCTG) that are specific for human β-actin.

TABLE 5

| | | | | | Sence primer | | |
|---|---|---|---|---|---|---|---|
| No | Probe ID | GenBank reference sequence ID | Name | Position | Sequence | | SEQ ID NO |
| TEG1 | 226973 | NM_080607 | AT868 | 1505-1525 | GGATTCTCTGCCCTGTCACAC | | 124 |
| TEG2 | 229215 | AI393930 | LS275 | 340-362 | CGGAGGGGAGAGGATTTTCTAAG | | 126 |

TABLE 5-continued

| | | | | | | |
|---|---|---|---|---|---|---|
| TEG3 | 239979 | BE645480 | LS291 | 356-377 | GGGATTAGGAATATGGGCTCTG | 128 |
| TEG4 | 244553 | AA447317 | LS309 | 72-93 | CATCACATCATTTCACCCCCAC | 130 |
| TEG5 | 242345 | AI217375 | LS301 | 315-336 | ATGTGCCTGCCACTACCTCATC | 132 |
| TEG6 | 228649 | AB062438 | LS501 | 161-180 | ACTCGCACAGGCACAGGGAT | 134 |
| TEG7 | 226936 | AL832235 | LS434 | 367-389 | TTCTGCCTGAAGAAGCGTCATAC | 136 |
| TEG8 | 238383 | BF825703 | LS762 | 345-372 | GCGCATTTTGAGAGAAGTTGGGTACTGG | 138 |
| TEG9 | 232593 | AL389981 | LS426 | 1310-1333 | AACCCCTCTTTCTGTCCATGCCAG | 140 |
| TEG10 | 242881 | BC017398 | LS547 | 107-128 | GCAGTCTTGGATGATGGGTTCC | 142 |
| TEG11 | 227140 | AI343467 | LS693 | 109-128 | TTTCTATGGCATTCCAGCGG | 144 |
| TEG12 | 231310 | BF067073 | BFF | 218-239 | CTTCACCTGCTCATTGCCTGTC | 146 |
| TEG13 | 237410 | H66658 | HF | 53-74 | AACGACGAAAAGAGAAGGACCC | 148 |
| TEG14 | 219918 | NM_018123.1 | ASPMF | 10078-10101 | AAAGTTGCAGACAAAGGCGGAAGC | 150 |
| TEG15 | 235845 | AI380207 | SPF | 337-357 | GACGGTGGGAACGGTTTAGAG | 152 |
| TEG16 | 232453 | AF339813.1 | AFF | 1158-1178 | CACCTGCATCCATAGCACAGC | 154 |
| TEG17 | 223594 | NM_032256 | LS153 | 1455-1479 | CCCTTCTTTGGTTTGCATCAGGTCT | 156 |
| TEG18 | 235229 | AB065686 | C7TM_F | 1247-1266 | TGTCTGTTGCATGCGGTTCA | 158 |
| TEG19 | 223582 | NM_032119 | AT864 | 18839-18859 | GGTCACTGATAGCCGATGAGG | 160 |
| TEG20 | 228236 | NM_033409 | C20054_F | 1298-1322 | GTTGGTCTCCATGTTCCTGCCTAAC | 162 |
| TEG21 | 220510 | NM020407 | RHBGF | 1355-1376 | CGAGCATGAGGATAAAGCCCAG | 164 |
| TEG22 | 223457 | NM_012133 | LS563 | 1001-1020 | TGGCAATGAAGCACCCCTCT | 166 |
| TEG23 | 229349 | AL039884 | LS899 | 454-481 | TCACATCTATCAACCACTGGCACCTACC | 168 |
| TEG24 | 231341 | BE670584 | LS307 | 178-197 | CAAGCAAATGCAATGGCTGG | 170 |
| TEG25 | 213880 | AL524520 | LS442 | 470-494 | GCTGTGTTCTCTCTGGATAACCCAC | 172 |
| TEG26 | 232321 | AK026404 | LS756 | 2049-2072 | CTGGGACCTTCCAAAACATTGGCT | 174 |
| TEG27 | 209589 | AF025304 | LS155 | 3638-3661 | TCCAGGTACATATCACGCGCACAG | 176 |
| TEG28 | 222155 | AK021918 | LS866 | 1574-1597 | GTGCTGTCGTGGGTGCTGTGTCTT | 178 |
| TEG29 | 230030 | BC037325 | AT878 | 2652-2675 | CTTGATAATGTGGGCAAACCCTT | 180 |
| TEG30 | 231725 | NM_018936 | AT882 | 31-52 | GGCCCTAGGATTGTCCACTCA | 182 |
| TEG31 | 232602 | XM_173052 | LS79 | 348-367 | GTGGGCCTGTGCATTGTTGG | 184 |
| TEG32 | 218796 | AK000123 | LS285 | 2894-2917 | CCTGTTTGCTGCTGAGAACATCTC | 186 |
| TEG33 | 204213 | NM_002644 | AT856 | 2323-2344 | ACAGAGACCAAAGAACCCAAGA | 188 |
| TEG34 | 204702 | NM_004289 | LS277 | 1989-2012 | TCTCCAGTGTACCCATGATGGAAG | 190 |
| TEG35 | 220445 | NM_004909 | LS269 | 250-272 | CACTGTGAGTTTCATGCCTGCTG | 192 |
| TEG36 | 215444 | NM_007028 | LS289 | 1358-1379 | GGGCTTGGTTTTGTGAGGTTCC | 194 |
| TEG37 | 231941 | AB037780 | LS118 | 3043-3069 | CCAAGTTACGTCAAAGTCTCAGGAGCA | 196 |
| TEG38 | 205890 | NM_006398 | LS450 | 227-250 | AAGAGAAGACCATCCACCTTACCC | 198 |
| TEG39 | 203903 | NM_014799 | HEPH_F | 2429-2448 | CGGCCAAGGACTGGACCAGA | 200 |
| TEG40 | 200616 | NM_014730 | K0152_F | 383-402 | ACTGCCAATCCTGCGTTCCA | 202 |
| TEG41 | 206043 | NM_014861 | K0703_F | 3000-3020 | CGCACCACGACGATGACGTTC | 204 |
| TEG42 | 202016 | NM_002402 | LS385 | 1985-2007 | GACCAATAGCATCTGTGCCAGAG | 206 |
| TEG43 | 212942 | AB033025 | LS381 | 5448-5470 | TCCTAAACCATTCACCAAGAGCA | 208 |
| TEG44 | 213712 | BF508639 | ELOVLF | 90-111 | AGCCTCCCTGTCTACTCCATTC | 210 |
| TEG45 | 213194 | NM_133631 | ROBF | 3719-3736 | GTGGAGGGAGGCCTGGAC | 212 |
| TEG46 | 224233 | BC002535 | FLJ1F | 1305-1325 | ATGCCACACAAGCCAGCTCAC | 214 |
| TEG47 | 206224 | NM_001898 | LS259 | 179-202 | GCTATGTCTTTGCACCAGCCACC | 216 |
| TEG48 | 227804 | NM_138463 | AT872 | 283-302 | TCCATTGTGTCGGGGATCTG | 218 |
| TEG49 | 225581 | NM_019051 | LS505 | 190-211 | AGCCGAGCATACACACCACC | 220 |
| TEG50 | 225802 | NM_052963 | LS507 | 1377-1397 | ATCCTACAACCGAGCCAACCG | 222 |
| TEG51 | 222848 | NM_022145 | LS561 | 467-488 | CCGCTGAACTCAGTCAATGGC | 224 |
| TEG52 | 203256 | NM_001793 | AT854 | 2745-2764 | TGGGCAGTTTGACTTCAGCA | 226 |
| TEG53 | 229225 | NM_003872 | AT874 | 2311-2331 | GTGTTCGAGGGAGTGATAGGG | 228 |
| TEG54 | 203953 | NM_001306 | CLD3_F | 504-526 | TGCACCAACTGCGTGCAGGACGA | 230 |
| TEG55 | 201428 | NM_001305 | CLD4_F | 582-601 | TGTTGGCCGGCCTTATGGTG | 232 |
| TEG56 | 204051 | NM_003014 | LS369 | 1298-1321 | GGGAGCTTCCGACTTCCTTACAGG | 234 |
| TEG57 | 218908 | NM024083 | ASPF | 1339-1362 | GGACTTGCGAGACTTCGTGAGGAG | 236 |
| TEG58 | 205564 | NM007003 | JMF | 5-28 | CTTCTCTTCCCTTCATTCTTCGCC | 238 |
| TEG59 | 207165 | NM012485 | RHAMMF | 2708-2731 | GGTTCTTAGGCTCCATCCTGTTTG | 240 |
| TEG60 | 212092 | NM_015068 | AT574 | 1969-1990 | AGACCAAGCACACCTGGCAACG | 242 |
| TEG61 | 206859 | NM_002571 | AT850 | 245-289 | CCCCGAGGACAACCTGGAGATCGTT | 244 |
| TEG62 | 223779 | NM_032654 | AT997 | 1161-1184 | CAACCACAGATCAGGGACAGGAGC | 246 |
| TEG63 | 205777 | NM001395 | DUSPF | 1868-1888 | GCTCTTTGTGAGTGAGGGTGG | 248 |
| TEG64 | 212147 | AB029012.1 | KIAAF | 4106-4127 | CAGTGGGCAGCAGAAAGGAGAG | 250 |
| β-actin | | | | | AGAAGGAGATCACTGCCCTGGCACC | 252 |

| | Antisence primer | | | |
|---|---|---|---|---|
| No | Name | Position | Sequence | SEQ ID NO |
| TEG1 | AT869 | 1661-1680 | CTTGGCACAGGACCCAAGAG | 125 |
| TEG2 | LS276 | 218-241 | GGTCCAGGTCATCTTTATTACGCC | 127 |
| TEG3 | LS292 | 264-286 | AATGAGGAAACTGAGGCATAAAG | 129 |
| TEG4 | LS310 | 195-218 | CCCCTTTTTTGTCCAGCTTACTC | 131 |
| TEG5 | LS302 | 152-171 | GCCACTGAACCAAAATCGGG | 133 |
| TEG6 | LS502 | 251-270 | GCCCCGCTCCAAACATCACT | 135 |
| TEG7 | LS435 | 467-490 | GCCATCCTCTCTGTCAAGTACCAG | 137 |
| TEG8 | LS763 | 433-456 | GAATTCGTGGTGGCATGCCCTTCT | 139 |
| TEG9 | LS427 | 1437-1460 | TCTTCAATACCCAGGAGGTACAGG | 141 |

TABLE 5-continued

| | | | | |
|---|---|---|---|---|
| TEG10 | LS548 | 283-306 | AAGGAGTTAGCAGCAGCCTAGTTG | 143 |
| TEG11 | LS694 | 30-52 | AGAAGCTATCAGGCGTTGCTGAA | 145 |
| TEG12 | BFR | 397-417 | TGCCGTGGTAATGTGAATCCC | 147 |
| TEG13 | HR | 142-164 | GGAAAGTGTTAGACGCAGAAGGC | 149 |
| TEG14 | ASPMR | 10156-10180 | TGGACCTACTTCGTACATCAGAGGC | 151 |
| TEG15 | SPR | 462-481 | AGGCTTCCAACTTCCGCTGC | 153 |
| TEG16 | AFR | 1232-1253 | TCGGAAGGGTGTGAAAGAGGAC | 155 |
| TEG17 | LS154 | 1559-1584 | CGTTGGGTCTTGATCAGCTTCTGTTG | 157 |
| TEG18 | C7TM_R | 1395-1416 | CCACGGTGTAGAAGAGCGATAC | 159 |
| TEG19 | AT865 | 18973-18992 | CTCCTGAGCTCCACGATCTG | 161 |
| TEG20 | C20054_R | 1480-1502 | CAGCATCACCTTGACGTAGCTGA | 163 |
| TEG21 | RHBGR | 1451-1473 | GTAGCAGCCAGTCAGCATCTTCG | 165 |
| TEG22 | LS564 | 1113-1135 | GGTCCACACTGCTCTCACTTCCT | 167 |
| TEG23 | LS900 | 398-403 | GGGTTCACTTTGGTCTCTAGTACGG | 169 |
| TEG24 | LS308 | 96-119 | GGATGTGCAGTGAAACTTGAAAGG | 171 |
| TEG25 | LS443 | 320-344 | GCCATTTGGTTTGGATGTATTGAAG | 173 |
| TEG26 | LS757 | 2167-2191 | CATTACCTGAGGCCTCTGAATTCGG | 175 |
| TEG27 | LS1S6 | 3753-3777 | CCAGATGCAGGATCAACCCTTCTCA | 177 |
| TEG28 | LS867 | 1723-1744 | CACGTGATAGATGCTGGTCGGG | 179 |
| TEG29 | AT879 | 2855-2874 | GCCCGGAATCATGATGCTTG | 181 |
| TEG30 | AT883 | 168-190 | TCAGGACTTGCCTTTGTTTCGG | 183 |
| TEG31 | LS80 | 501-520 | TAGGGCACCGGGATCTCTAA | 185 |
| TEG32 | LS286 | 3034-3056 | AACGCTCCCCTGAAAACTGTAAC | 187 |
| TEG33 | AT857 | 2488-2510 | GGATCGACATGATTCTGAAGGTG | 189 |
| TEG34 | LS278 | 2249-2271 | CCCACAAGTGTGATCTTGAAGTCC | 191 |
| TEG35 | LS270 | 352-372 | TCGTGGTTTCCTGGACATCTTC | 193 |
| TEG36 | LS290 | 1677-1698 | CAGGGACTTCCTTTTTCCATCAG | 195 |
| TEG37 | LS119 | 3161-3185 | TCTGAAGGGGTGAAGTTCTTGAGGG | 197 |
| TEG38 | LS451 | 348-369 | TGCTTTCACTTGTGCCACTGAG | 199 |
| TEG39 | HEPH_R | 2535-2559 | ACTCCATGAGCATGCACAGAGTAGG | 201 |
| TEG40 | K0152_R | 551-573 | CGACGTGGCCATTCAATCGTACA | 203 |
| TEG41 | K0703_R | 3119-3140 | GATGGACCCCAGGACGGAGTAG | 205 |
| TEG42 | LS386 | 2064-2088 | TGCTTCTAACCACTGAGGTATGAGG | 207 |
| TEG43 | LS382 | 5565-5586 | GAGCGTTGCTTTCCTTAAAGACC | 209 |
| TEG44 | ELOVLR | 323-342 | GGTAAAGTCCTCACCCCTGC | 211 |
| TEG45 | ROBR | 3773-3791 | TTAGGCCACGTGTCTGCCA | 213 |
| TEG46 | FLJ1R | 1419-1440 | CAGCAGCAGATGGGAAGAACTC | 215 |
| TEG47 | LS260 | 319-341 | GCCCACCTCTACGTCGAAGAAGT | 217 |
| TEG48 | AT873 | 382-401 | TACCCCGCAGAGAAGCAAAC | 219 |
| TEG49 | LS506 | 277-296 | TCCAGGGAGATGTCTTGCCA | 221 |
| TEG50 | LS508 | 1479-1498 | CCTGCTCCTTCTTTGCCTGG | 223 |
| TEG51 | LS562 | 643-662 | TGCTGTTCATCCAACCACCG | 225 |
| TEG52 | AT855 | 2867-2887 | CACTGTAGGTCAGTCACAGCA | 227 |
| TEG53 | AT875 | 2509-2529 | CAGACCCTGAGGTTGCAGAA | 229 |
| TEG54 | CLD3_R | 628-652 | GGCACCACGGGGTTGTAGAAGTCCC | 231 |
| TEG55 | CLD4_R | 770-790 | GGCGGAGTAAGGCTTGTCTGT | 233 |
| TEG56 | LS370 | 1456-1478 | CCTACCACTATGGCTTGTGATGG | 235 |
| TEG57 | ASPR | 1429-1450 | CTGAAAGAGGGTCTGCGTGTGG | 237 |
| TEG58 | JMR | 108-131 | CCTCCTGACCATCTCCTCTTCCTC | 239 |
| TEG59 | RHAMMR | 2861-2886 | GCTGAGTAGACATGCAGATGACAAGC | 241 |
| TEG60 | AT575 | 2087-2108 | ATCTTCCTTGTCCGTCTCGTCC | 243 |
| TEG61 | AT851 | 348-372 | CCTCGTTCGCCACCGTATAGTTGAT | 245 |
| TEG62 | AT998 | 1330-1349 | GGACAGTGGCGATTTCAACC | 247 |
| TEG63 | DUSPR | 2043-2063 | ACAGGGGTGTGGACAGAAATG | 249 |
| TEG64 | KIAAR | 4309-4327 | GGGAGGAGCTGAGGCAATC | 251 |
| β-actin | | | CCTGCTTGCTGATCCACATCTGCT | 253 |

The product amplified by the PCR method was subjected to electrophoresis on 1.0% agarose gel and stained with ethidium bromide to observe the bands. The mRNA level was determined by iCyclerQ real time PCR analysis system (BIO-RAD).

Expression Analysis of TEG1

Gene expression was compared by a quantitative RT-PCR method using RNA prepared from 12 cases of lung adenocarcinoma tissue and 4 cases of normal lung tissue.

The PCR result showed that, while the expression of mRNA of TEG1 gene was not observed in the normal lung tissue, overexpression of TEG1 gene was observed clearly in 10 cases out of the analyzed 12 cases of lung adenocarcinoma tissue (FIG. 1).

Figure 73:
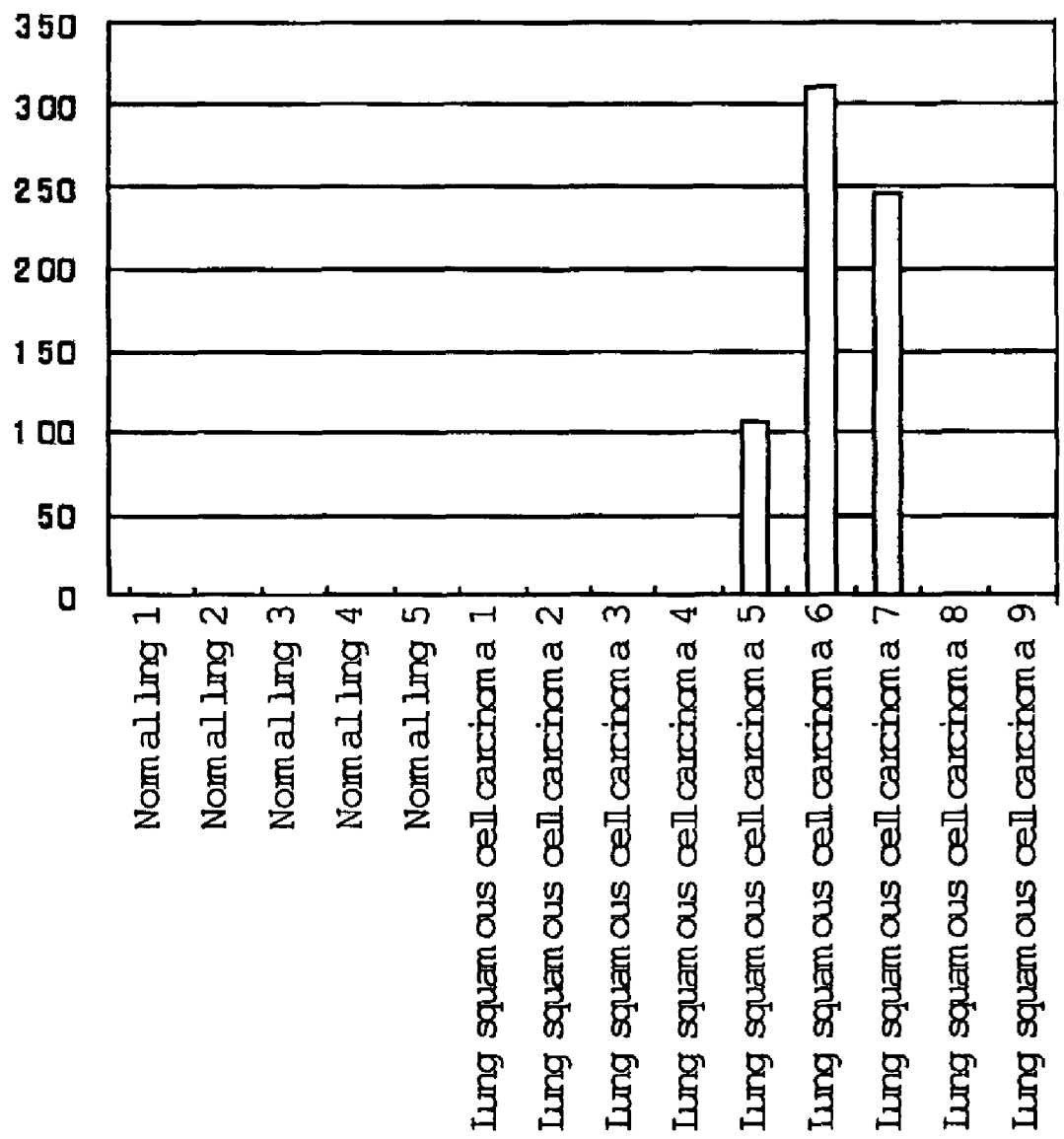
FIG. 73 shows the expression of C20orf102 gene in lung squamous cell carcinoma.

A quantitative PCR analysis was carried out for 5 cases of normal lung and 9 cases of lung squamous cell carcinoma in the same manner. The PCR result showed that, while the expression of mRNA of TEG1 gene was not observed in the normal lung tissue, an elevation in the expression of TEG1 gene was observed in 3 cases out of the analyzed 9 cases of lung squamous cell carcinoma tissue (FIG. 73).

Expression Analysis of TEG2

Gene expression was compared by an RT-PCR method using RNA prepared from 5 cases of large bowel cancer tissue and normal large bowel tissue in non-cancerous part of the same samples, and RNA prepared from 11 cases of stomach cancer tissue and normal stomach tissue in non-cancerous part of the same samples.

Figure 2:
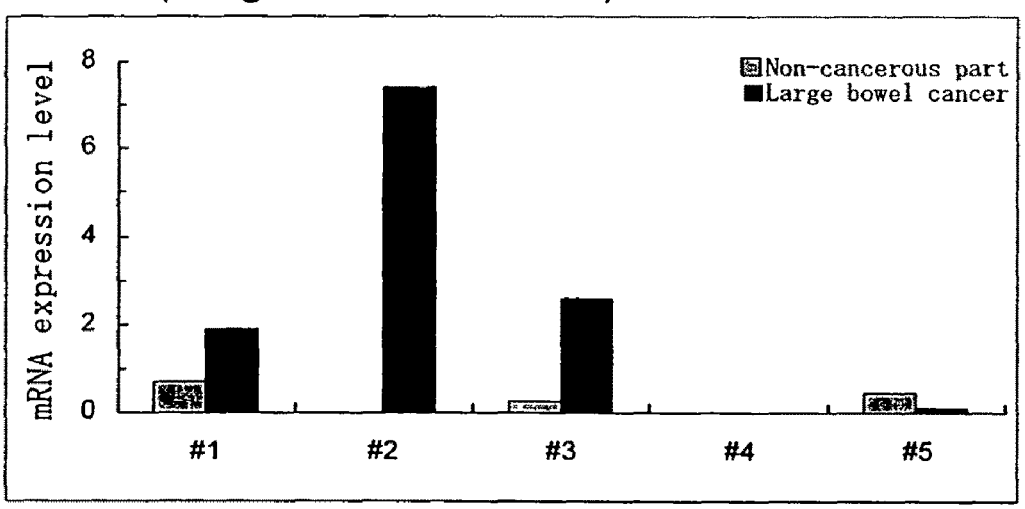
FIG. 2 shows the results of an expression analysis of a cancer-associated gene TEG2.
Figure 3:
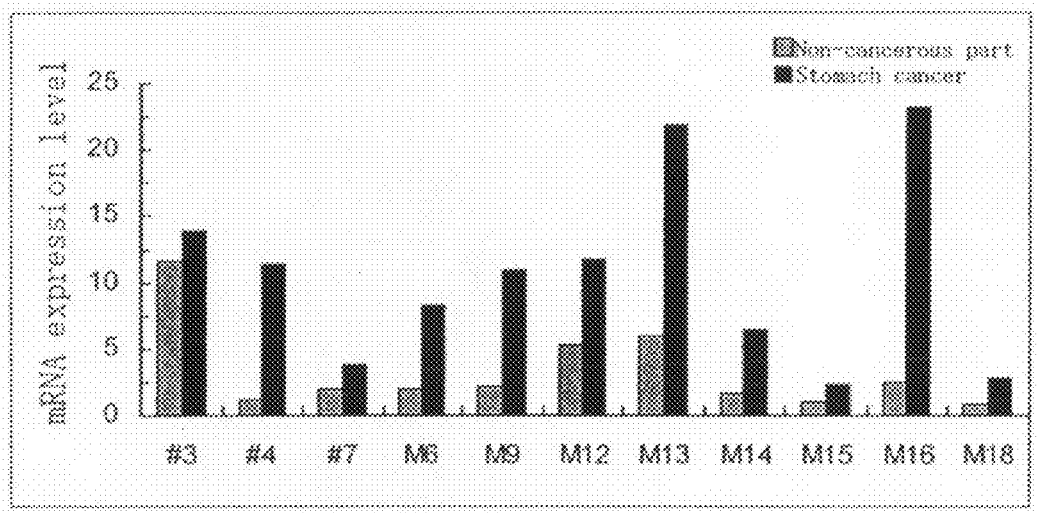
FIG. 3 shows the results of an expression analysis of a cancer-associated gene TEG2.

The PCR result showed that, an elevation in the expression of mRNA of TEG2 gene was observed in the cancerous part in 3 cases out of 5 cases of the analyzed large bowel cancer and in all the 11 cases of stomach cancer (FIGS. 2 and 3).

Expression Analysis of TEG3

Gene expression was compared by an RT-PCR method using RNA prepared from 11 cases of stomach cancer tissue and normal stomach tissue in non-cancerous part of the same samples.

Figure 4:
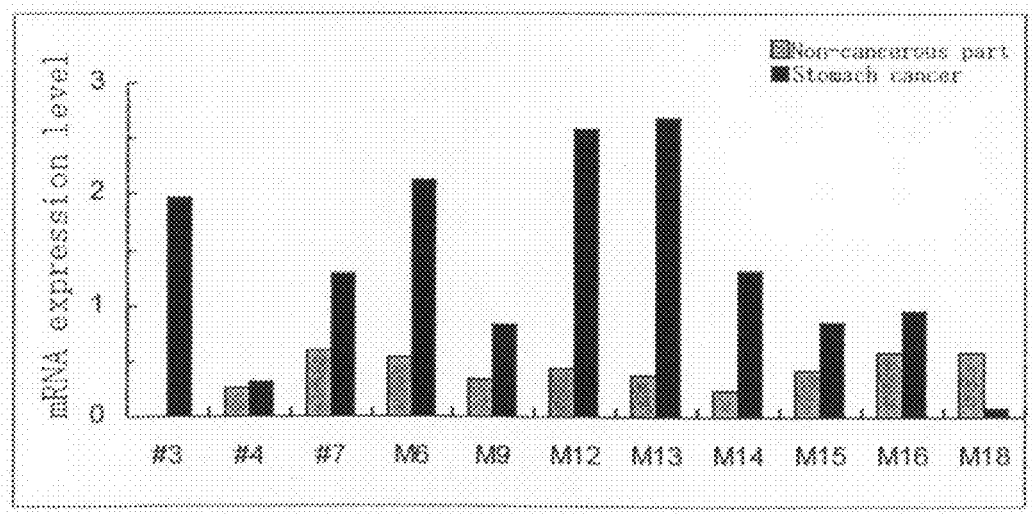
FIG. 4 shows the results of an expression analysis of a cancer-associated gene TEG3.

The PCR result showed that, an elevation in the expression of mRNA of TEG3 gene was observed clearly in the cancerous part in 9 cases out of 11 cases of the analyzed stomach cancer (FIG. 4).

Expression Analysis of TEG4

Gene expression was compared by an RT-PCR method using RNA prepared from 11 cases of stomach cancer tissue and normal stomach tissue in non-cancerous part of the same samples.

Figure 5:
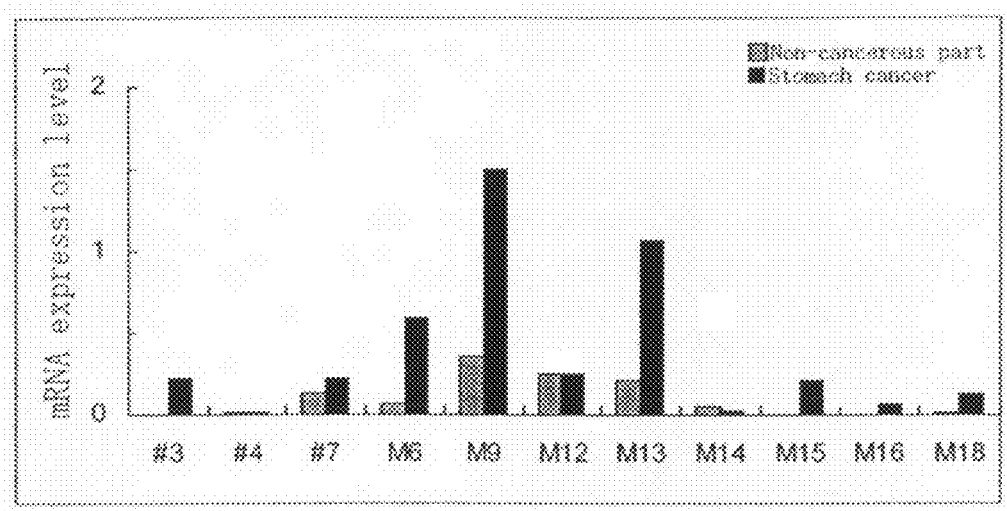
FIG. 5 shows the results of an expression analysis of a cancer-associated gene TEG4.

The PCR result showed that, an elevation in the expression of mRNA of TEG4 gene was observed clearly in the cancerous part in 7 cases out of 11 cases of the analyzed stomach cancer (FIG. 5).

Expression Analysis of TEG5

Gene expression was compared by an RT-PCR method using RNA prepared from 11 cases of stomach cancer tissue and normal stomach tissue in non-cancerous part of the same samples.

Figure 6:
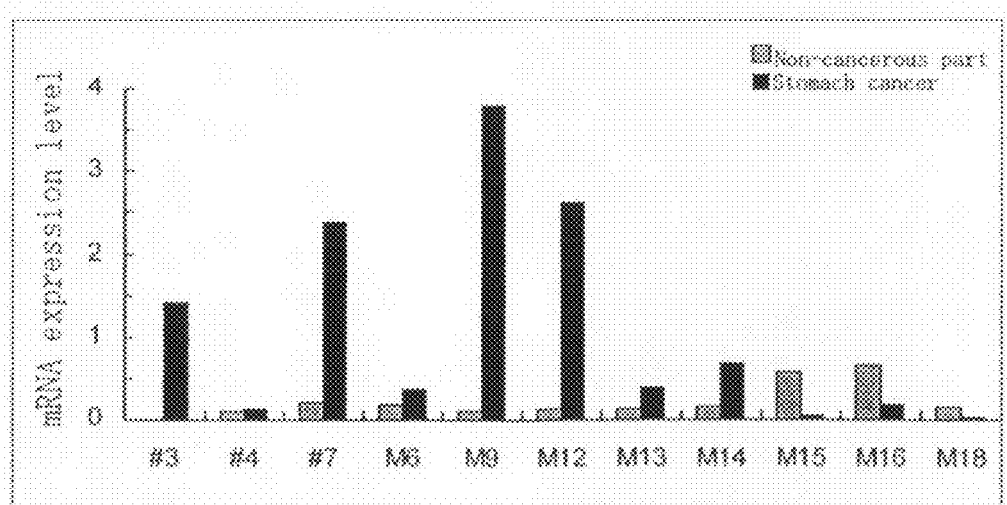
FIG. 6 shows the results of an expression analysis of a cancer-associated gene TEG5.

The PCR result showed that, an elevation in the expression of mRNA of TEG5 gene was observed clearly in the cancerous part in 7 cases out of 11 cases of the analyzed stomach cancer (FIG. 6).

Expression Analysis of TEG6

Gene expression was compared by an RT-PCR method using RNA prepared from 9 cases of large bowel cancer tissue and normal large bowel tissue in non-cancerous part of the same samples, and RNA prepared from 11 cases of stomach cancer tissue and normal stomach tissue in non-cancerous part of the same samples.

Figure 7:
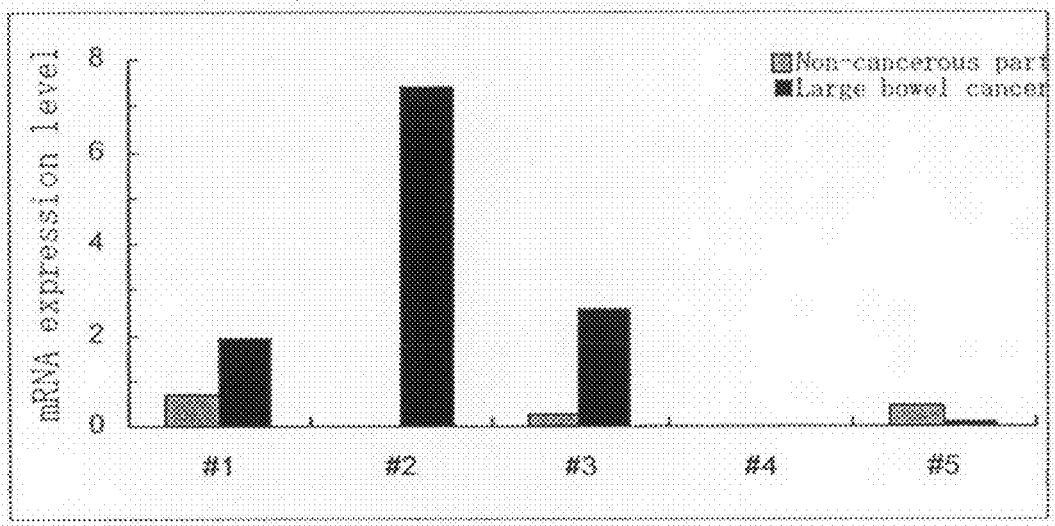
FIG. 7 shows the results of an expression analysis of a cancer-associated gene TEG6.
Figure 8:
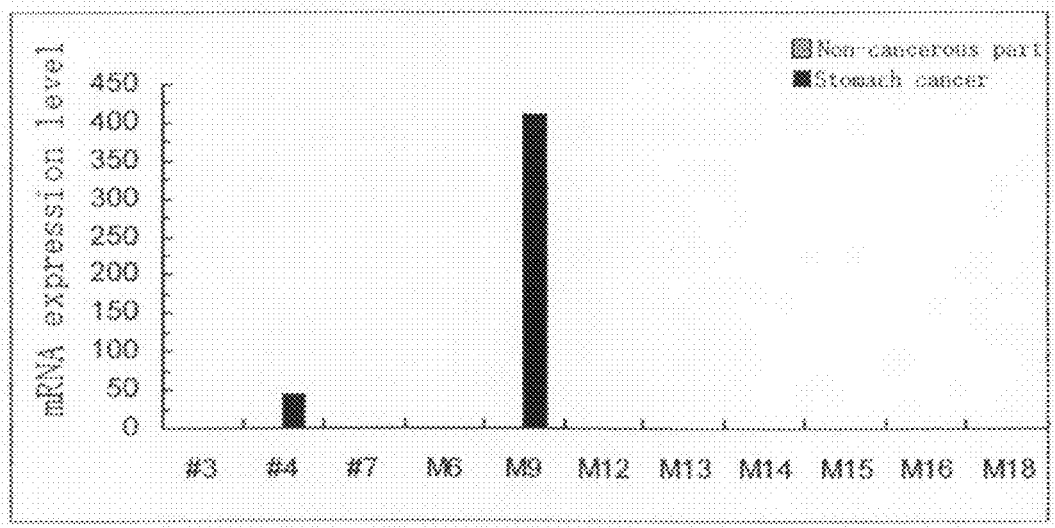
FIG. 8 shows the results of an expression analysis of a cancer-associated gene TEG6.

The PCR result showed that, an elevation in the expression of mRNA of TEG6 gene was observed clearly in the cancerous part in 3 cases out of 9 cases of the analyzed large bowel cancer. As for the stomach cancer, while no expression of mRNA was observed in all the analyzed normal stomach, very strong expression of mRNA was observed in 2 cases (FIGS. 7 and 8).

Expression Analysis of TEG7

Gene expression was compared by an RT-PCR method using RNA prepared from 11 cases of stomach cancer tissue and normal stomach tissue in non-cancerous part of the same samples.

Figure 9:
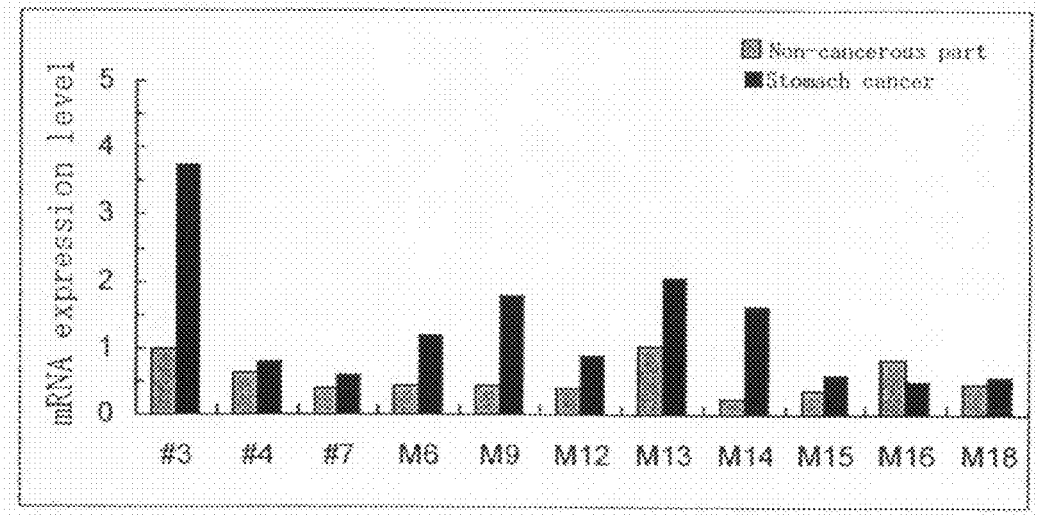
FIG. 9 shows the results of an expression analysis of a cancer-associated gene TEG7.

The PCR result showed that, an elevation in the expression of mRNA of TEG7 gene was observed clearly in the cancerous part in 6 cases out of 11 cases of the analyzed stomach cancer (FIG. 9).

Expression Analysis of TEG8

Gene expression was compared by an RT-PCR method using RNA prepared from 11 cases of stomach cancer tissue and normal stomach tissue in non-cancerous part of the same samples.

Figure 10:
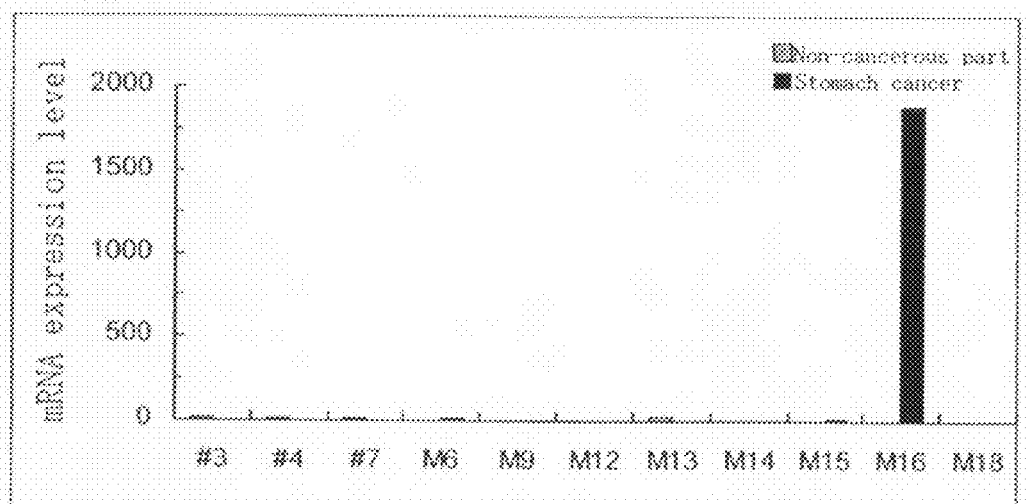
FIG. 10 shows the results of an expression analysis of a cancer-associated gene TEG8.

The PCR result showed that, while very little expression of mRNA of TEG8 gene was observed in the analyzed normal stomach, significant expression of mRNA was observed in 1 case out of 11 cases of stomach cancer (FIG. 10).

Expression Analysis of TEG9

Gene expression was compared by an RT-PCR method using RNA prepared from 11 cases of stomach cancer tissue and normal stomach tissue in non-cancerous part of the same samples.

Figure 11:
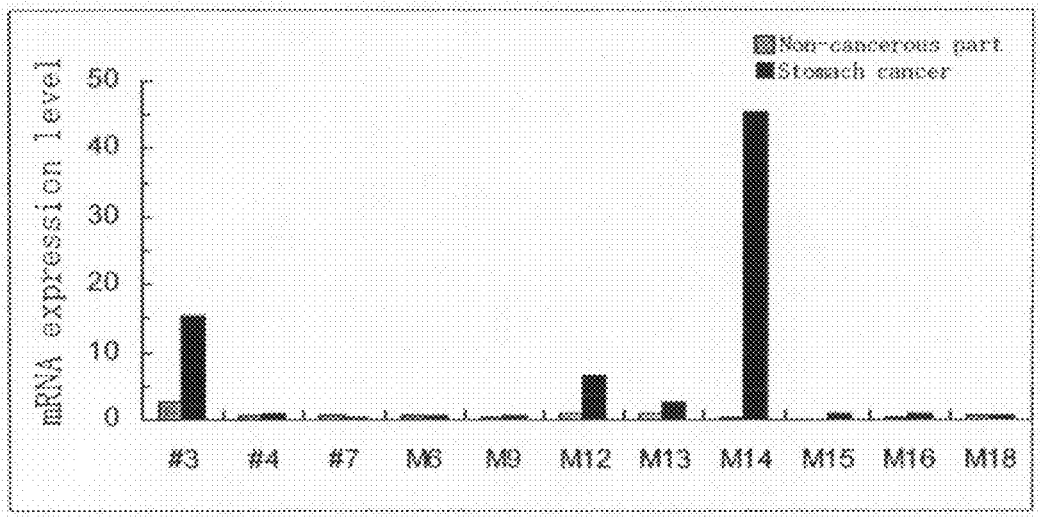
FIG. 11 shows the results of an expression analysis of a cancer-associated gene. TEG9.

The PCR result showed that, an elevation in the expression of mRNA of TEG9 gene was observed clearly in the cancerous part in 6 cases out of 11 cases of the analyzed stomach cancer (FIG. 11).

Expression Analysis of TEG10

Gene expression was compared by an RT-PCR method using RNA prepared from 11 cases of stomach cancer tissue and normal stomach tissue in non-cancerous part of the same samples.

Figure 12:
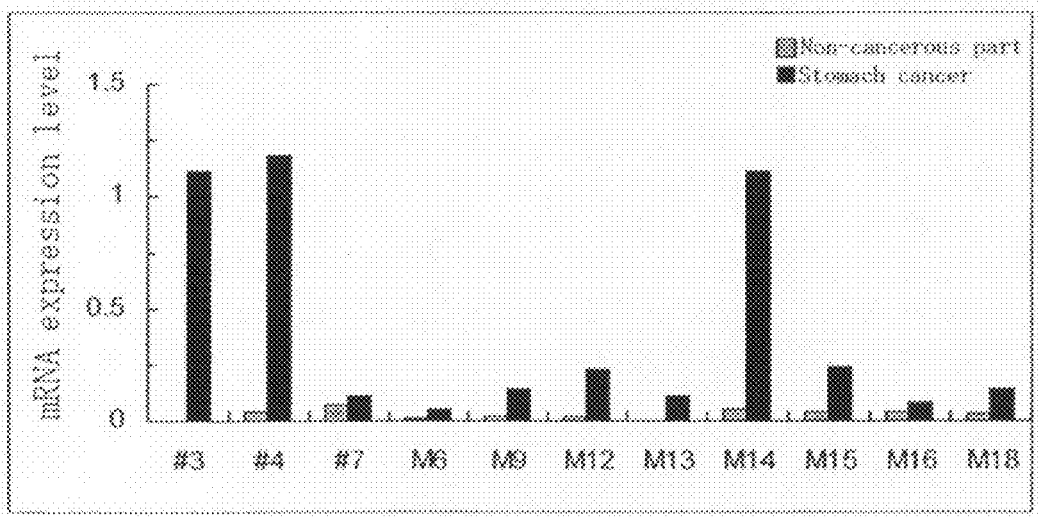
FIG. 12 shows the results of an expression analysis of a cancer-associated gene TEG10.

The PCR result showed that, an elevation in the expression of mRNA of TEG10 gene was observed clearly in the cancerous part in 10 cases out of 11 cases of the analyzed stomach cancer (FIG. 12).

Expression Analysis of TEG11

Gene expression was compared by an RT-PCR method using RNA prepared from 11 cases of stomach cancer tissue and normal stomach tissue in non-cancerous part of the same samples.

Figure 13:
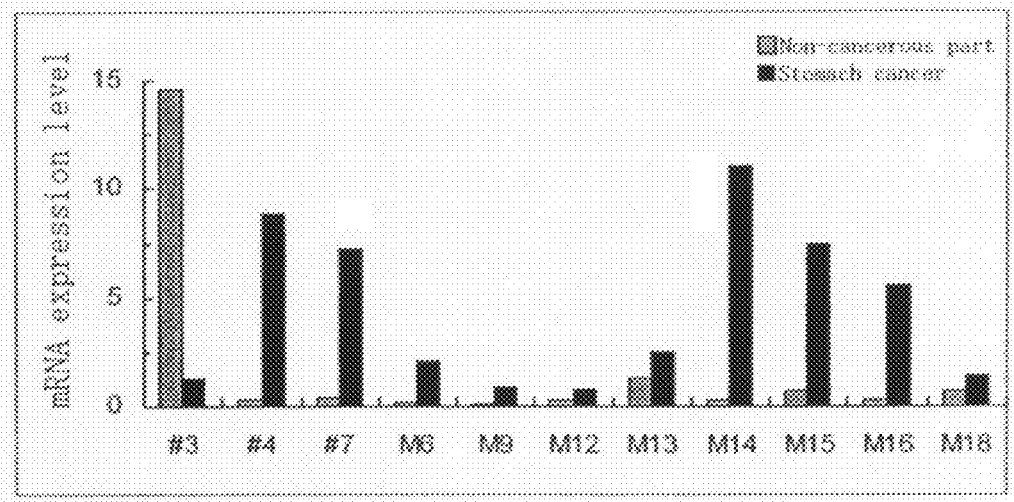
FIG. 13 shows the results of an expression analysis of a cancer-associated gene TEG11.

The PCR result showed that, an elevation in the expression of mRNA of TEG11 gene was observed clearly in the cancerous part in 10 cases out of 11 cases of the analyzed stomach cancer (FIG. 13).

Expression Analysis of TEG12

Gene expression was compared by an RT-PCR method using RNA prepared from 9 cases of liver cancer tissue and non-cancerous part of the same samples.

Figure 14:
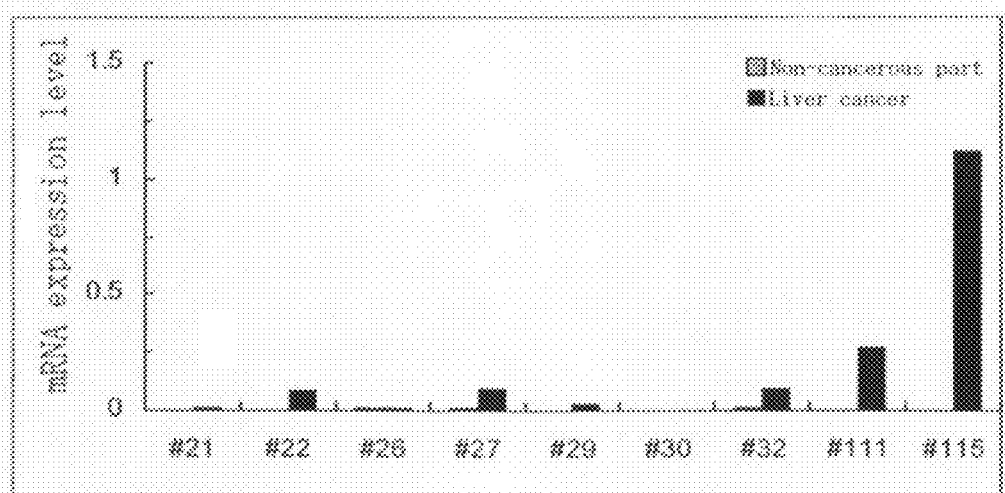
FIG. 14 shows the results of an expression analysis of a cancer-associated gene TEG12.

The PCR result showed that, an elevation in the expression of mRNA of TEG12 gene was observed clearly in the cancerous part in 6 cases out of 9 cases of the analyzed liver cancer, and in particular, a significant elevation in the expression of mRNA was observed in moderately differentiated liver cancer (#21, 29, 32) and poorly differentiated liver cancer (#22, 111, 115) (FIG. 14).

Expression Analysis of TEG13

Gene expression was compared by an RT-PCR method using RNA prepared from 9 cases of liver cancer tissue and non-cancerous part of the same samples.

Figure 15:
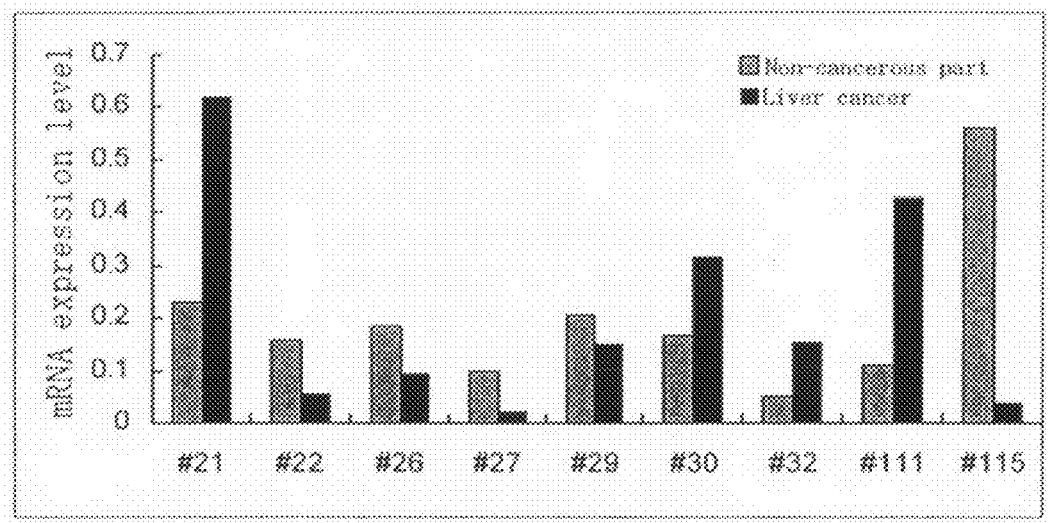
FIG. 15 shows the results of an expression analysis of a cancer-associated gene TEG13.

The PCR result showed that, an elevation in the expression of mRNA of TEG13 gene was observed clearly in the cancerous part in 4 cases out of 9 cases of the analyzed liver cancer (FIG. 15).

Expression Analysis of TEG14

Gene expression was compared by an RT-PCR method using RNA prepared from 9 cases of liver cancer tissue and non-cancerous part of the same samples.

Figure 16:
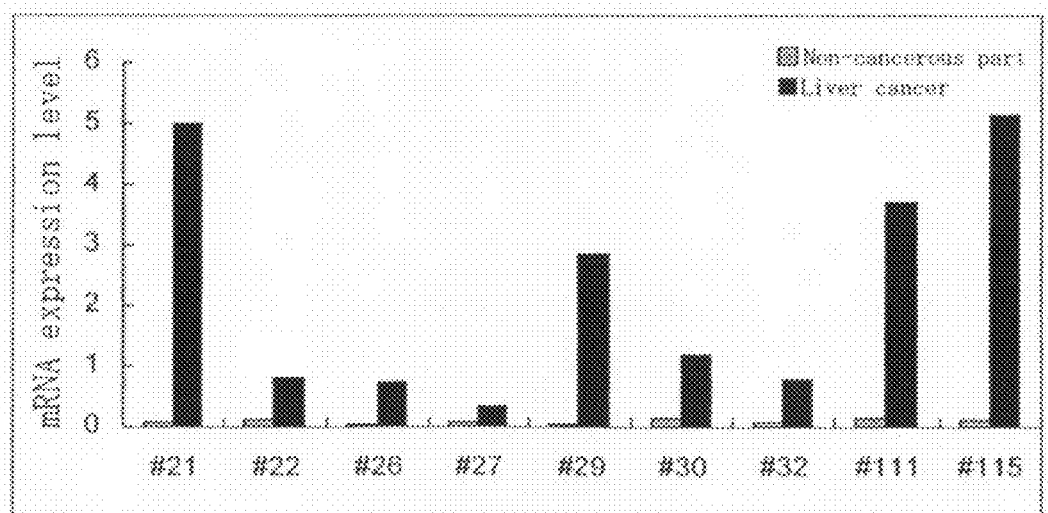
FIG. 16 shows the results of an expression analysis of a cancer-associated gene TEG14.

The PCR result showed that, a significant elevation in the expression of mRNA of TEG14 gene was observed in the cancerous part in all the 9 cases of the analyzed liver-cancer (FIG. 16).

Expression Analysis of TEG15

Gene expression was compared by an RT-PCR method using RNA prepared from 9 cases of liver cancer tissue and non-cancerous part of the same samples.

Figure 17:
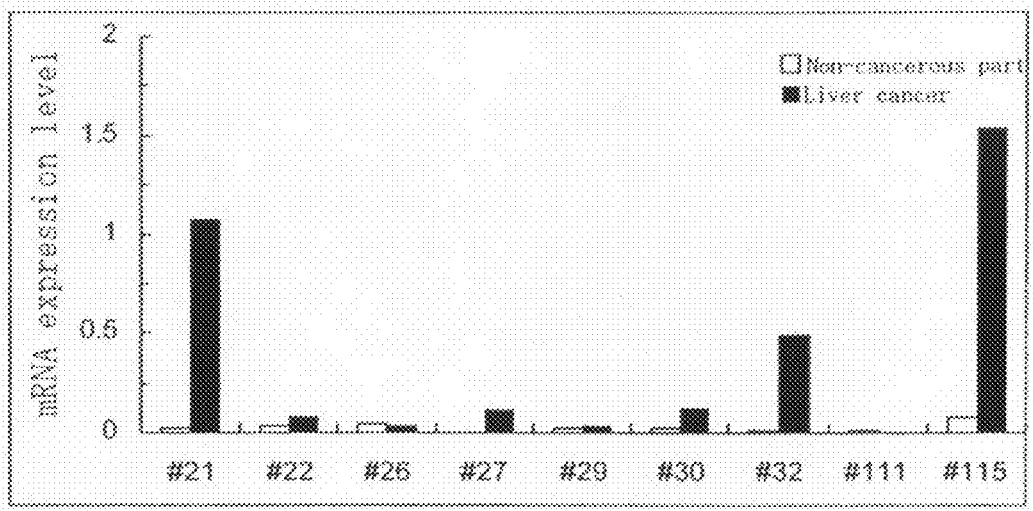
FIG. 17 shows the results of an expression analysis of a cancer-associated gene TEG15.

The PCR result showed that, a significant elevation in the expression of mRNA of TEG15 gene was observed in the cancerous part in 6 cases out of 9 cases of the analyzed liver cancer (FIG. 17).

Expression Analysis of TEG16

Gene expression was compared by an RT-PCR method using RNA prepared from 9 cases of liver cancer tissue and non-cancerous part of the same samples.

Figure 18:
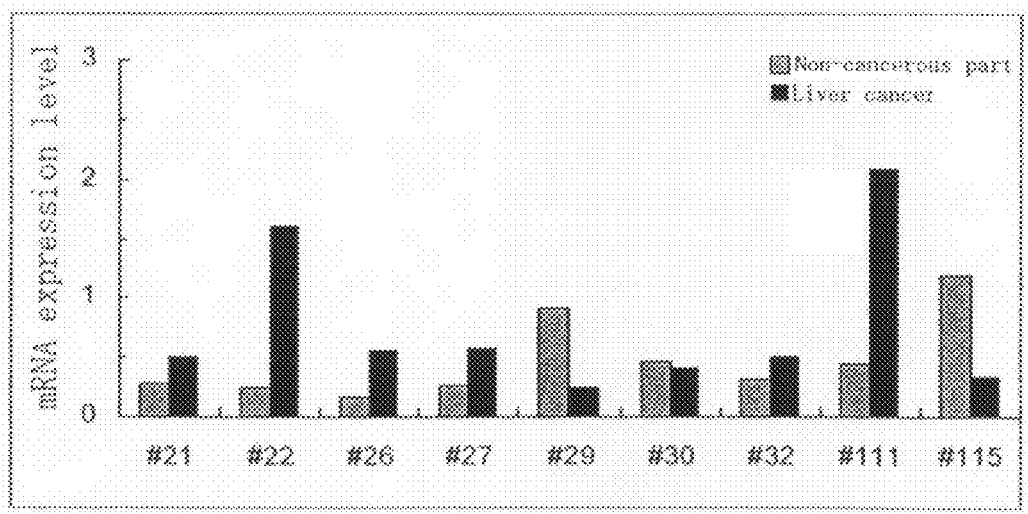
FIG. 18 shows the results of an expression analysis of a cancer-associated gene TEG16.

The PCR result showed that, a significant elevation in the expression of mRNA of TEG16 gene was observed in the cancerous part in 5 cases out of 9 cases of the analyzed liver cancer (FIG. 18).

Expression Analysis of TEG17

Gene expression was compared by an RT-PCR method using RNA prepared from 10 cases of large bowel cancer tissue and normal large bowel tissue in non-cancerous part of the same samples.

Figure 19:
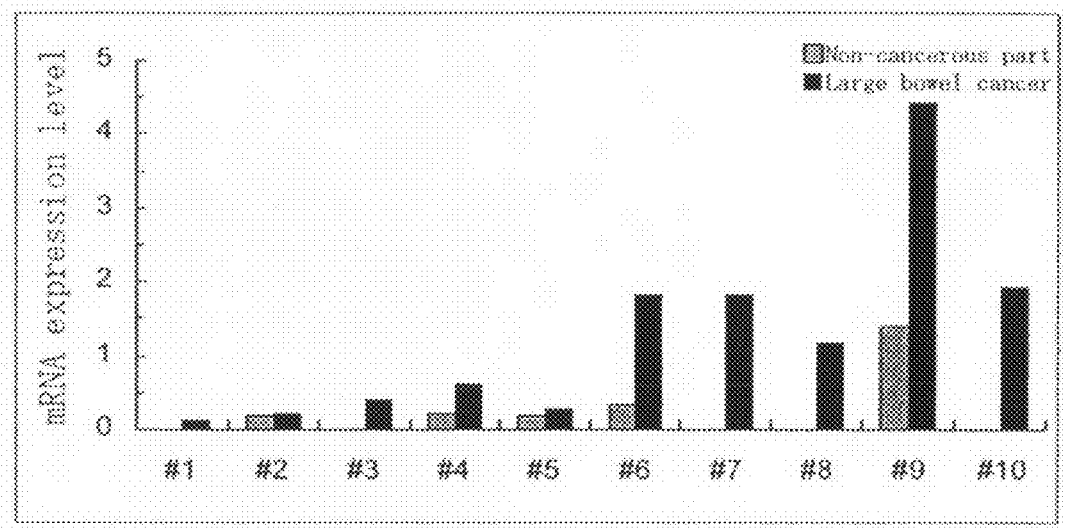
FIG. 19 shows the results of an expression analysis of a cancer-associated gene TEG17.

The PCR result showed that, an elevation in the expression of mRNA of TEG17 gene was observed in the cancerous part in all the analyzed 10 cases, and in particular, the gene was clearly overexpressed in 5 cases (FIG. 19).

Expression Analysis of TEG18

Gene expression was compared by an RT-PCR method using RNA prepared from 11 cases of stomach cancer tissue and normal stomach tissue in non-cancerous part of the same samples.

Figure 20:
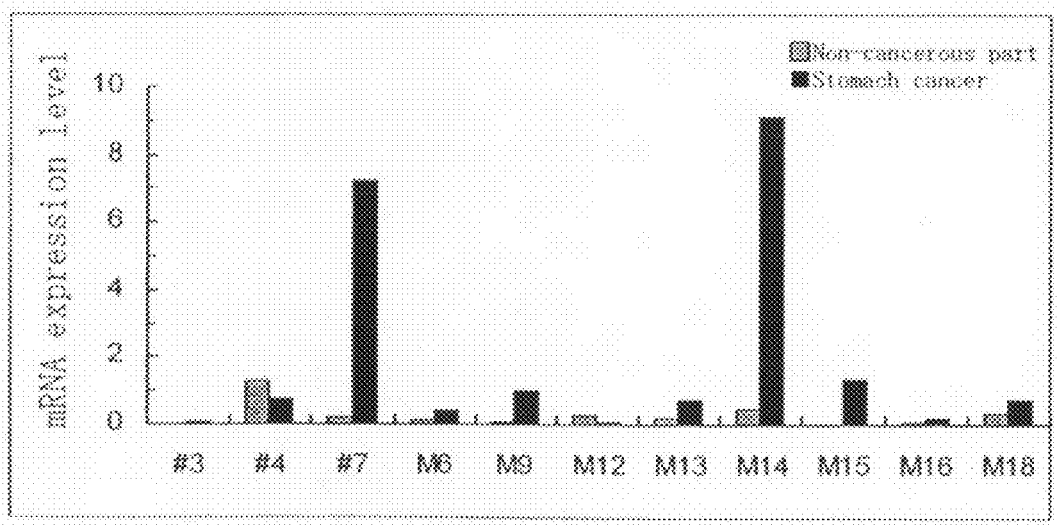
FIG. 20 shows the results of an expression analysis of a cancer-associated gene TEG18.

The PCR result showed that, an elevation in the expression of mRNA of TEG18 gene was observed clearly in the cancerous part in 7 cases out of 11 cases of the analyzed stomach cancer (FIG. 20).

Expression Analysis of TEG19

Gene expression was compared by a quantitative RT-PCR method using RNA prepared from 12 cases of lung adenocarcinoma tissue and 4 cases of normal lung tissue.

Figure 21:
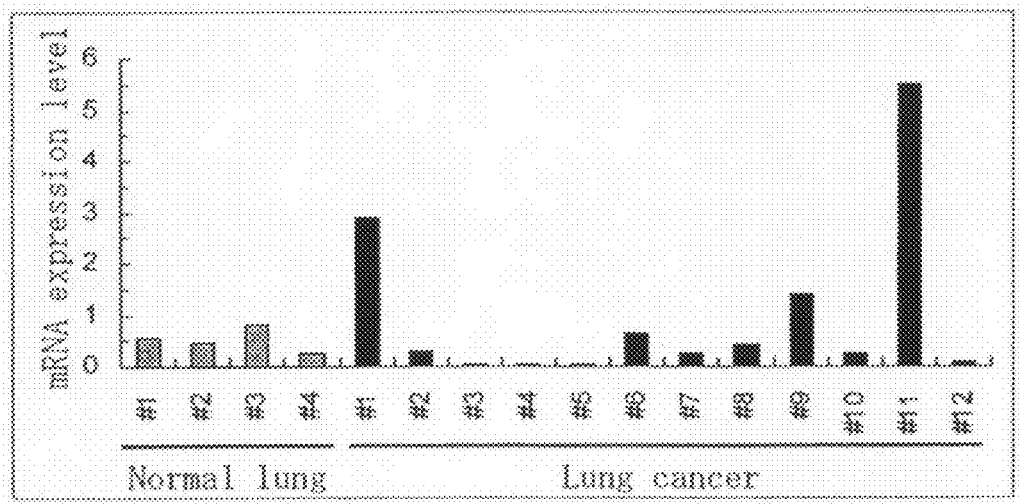
FIG. 21 shows the results of an expression analysis of a cancer-associated gene TEG19.

The PCR result showed that, while the expression of mRNA of TEG19 gene was not observed in the normal lung tissue, it was found that the expression of mRNA is clearly elevated in 3 cases out of the analyzed 12 cases of lung adenocarcinoma tissue (FIG. 21).

Expression Analysis of TEG20

Gene expression was compared by an RT-PCR method using RNA prepared from 11 cases of stomach cancer tissue and normal stomach tissue in non-cancerous part of the same samples.

Figure 22:
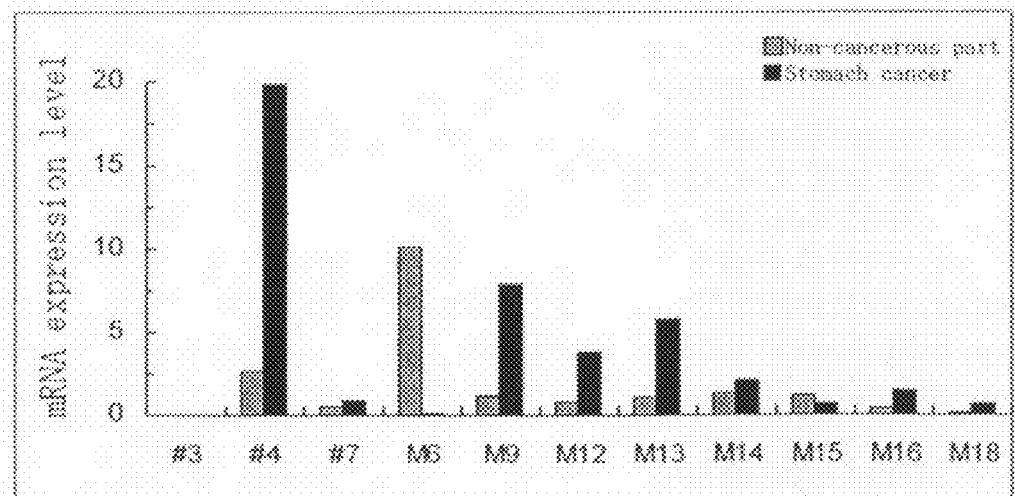
FIG. 22 shows the results of an expression analysis of a cancer-associated gene TEG20.

The PCR result showed that, an elevation in the expression of mRNA of TEG20 gene was observed clearly in the cancerous part in 6 cases out of 11 cases of the analyzed stomach cancer (FIG. 22).

Expression Analysis of TEG21

Gene expression was compared by an RT-PCR method using RNA prepared from 9 cases of liver cancer tissue and non-cancerous part of the same samples.

Figure 23:
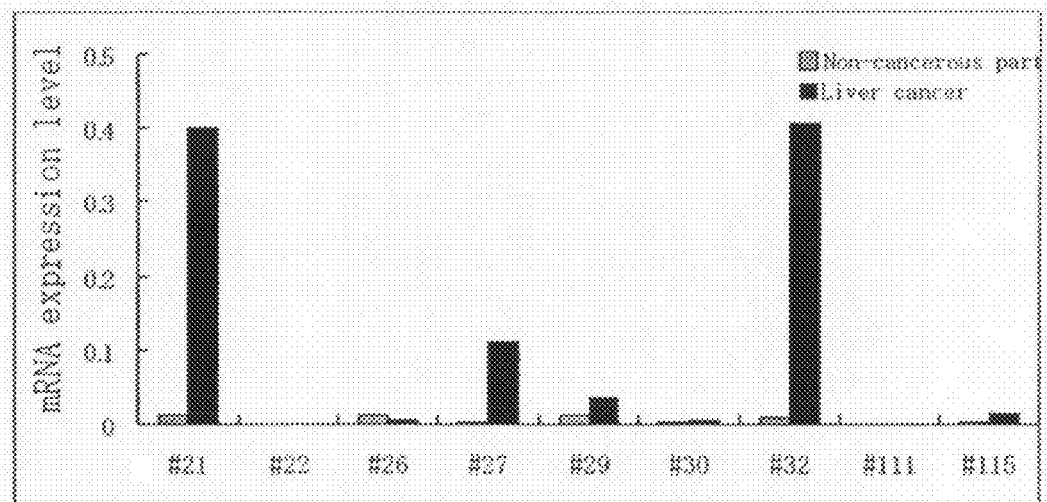
FIG. 23 shows the results of an expression analysis of a cancer-associated gene TEG21.

The PCR result showed that, an elevation in the expression of mRNA of TEG21 gene was observed clearly in the cancerous part in 5 cases out of 9 cases of the analyzed liver cancer, and in particular, a significant elevation in the expression of mRNA was observed in moderately differentiated liver cancer (#21, 27, 29, 32) (FIG. 23).

Expression Analysis of TEG22

Gene expression was compared by a quantitative RT-PCR method using RNA prepared from 6 cases of large bowel cancer tissue and normal large bowel tissue in non-cancerous part of the same samples.

Figure 24:
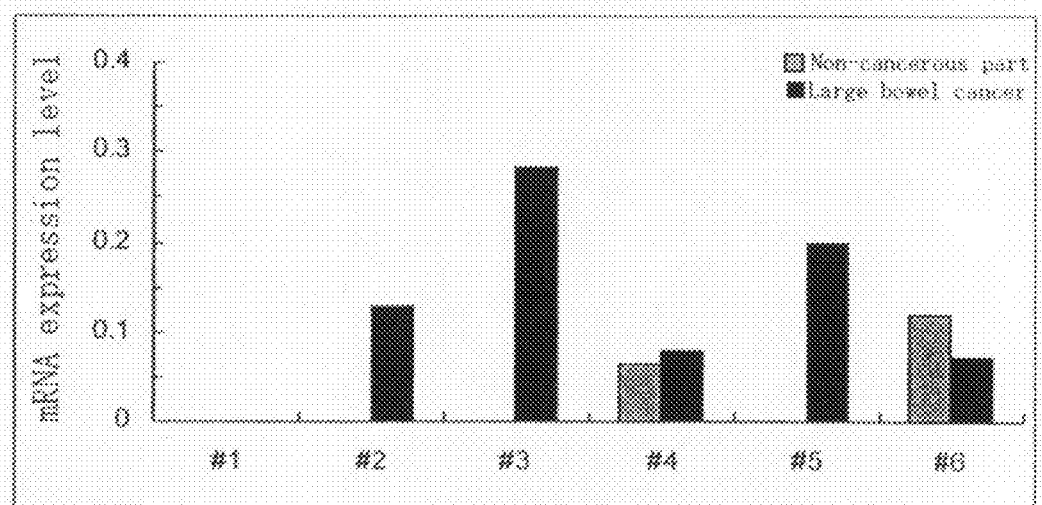
FIG. 24 shows the results of an expression analysis of a cancer-associated gene TEG22.

The PCR result showed that, an elevation in the expression of mRNA of TEG22 gene was observed in the cancerous part in 3 cases out of the analyzed 6 cases (FIG. 24).

Expression Analysis of TEG23

Gene expression was compared by an RT-PCR method using RNA prepared from 9 cases of liver cancer tissue and non-cancerous part of the same samples.

Figure 25:
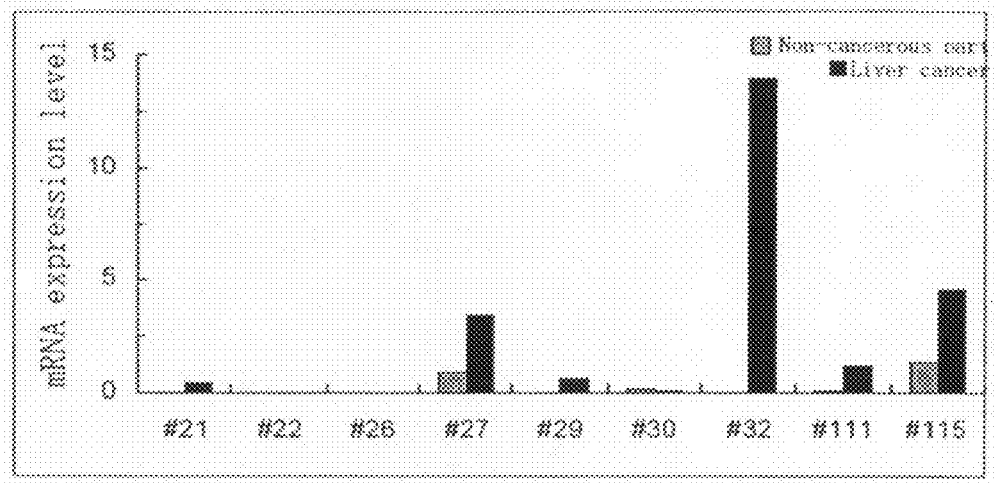
FIG. 25 shows the results of an expression analysis of a cancer-associated gene TEG23.

The PCR result showed that, an elevation in the expression of mRNA of TEG23 gene was observed clearly in the cancerous part in 6 cases out of 9 cases of the analyzed liver cancer (FIG. 25).

Expression Analysis of TEG24

Gene expression was compared by an RT-PCR method using RNA prepared from 11 cases of stomach cancer tissue and normal stomach tissue in non-cancerous part of the same samples.

Figure 26:
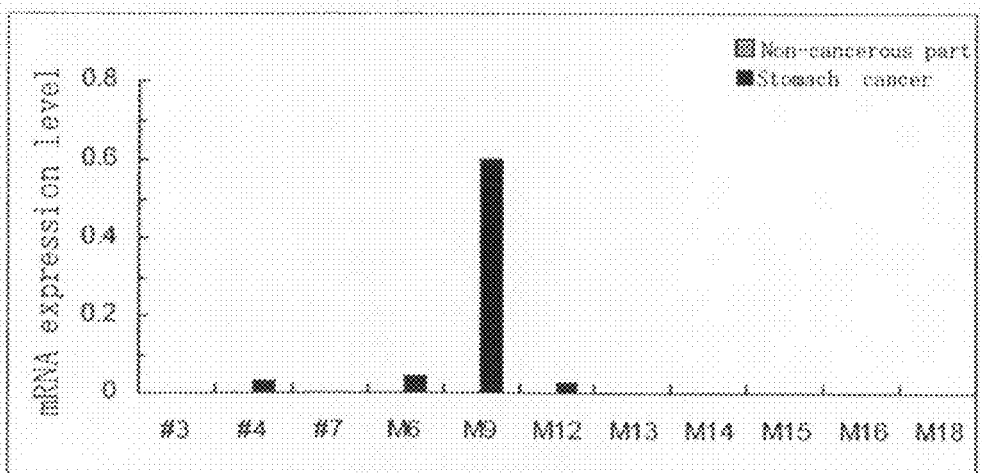
FIG. 26 shows the results of an expression analysis of a cancer-associated gene TEG24.

The PCR result showed that, an elevation in the expression of mRNA of TEG24 gene was observed clearly in the cancerous part in 5 cases out of 11 cases of the analyzed stomach cancer (FIG. 26).

Expression Analysis of TEG25

Gene expression was compared by an RT-PCR method using RNA prepared from 11 cases of stomach cancer tissue and normal stomach tissue in non-cancerous part of the same samples.

Figure 27:
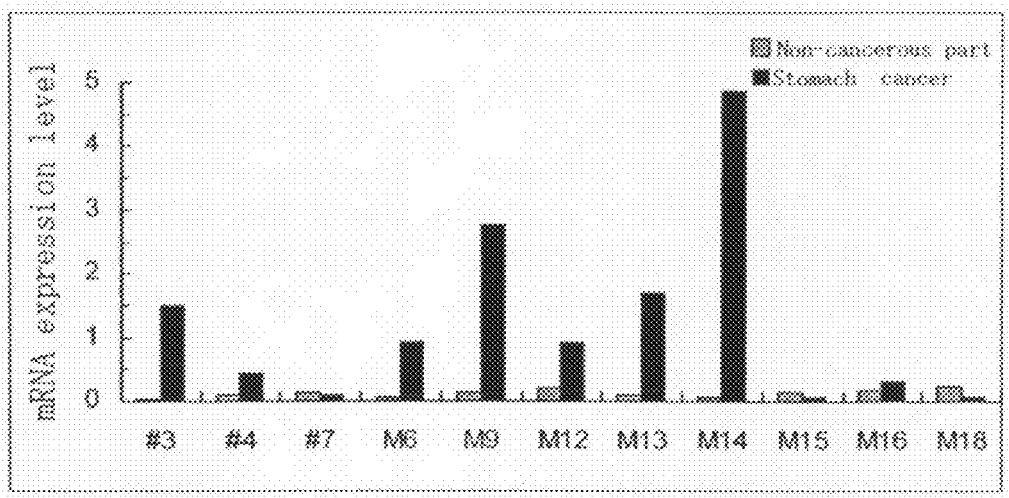
FIG. 27 shows the results of an expression analysis of a cancer-associated gene TEG25.

The PCR result showed that, an elevation in the expression of mRNA of TEG25 gene was observed clearly in the cancerous part in 7 cases out of 11 cases of the analyzed stomach cancer (FIG. 27).

Expression Analysis of TEG26

Gene expression was compared by an RT-PCR method using RNA prepared from 11 cases of stomach cancer tissue and normal stomach tissue in non-cancerous part of the same samples.

Figure 28:
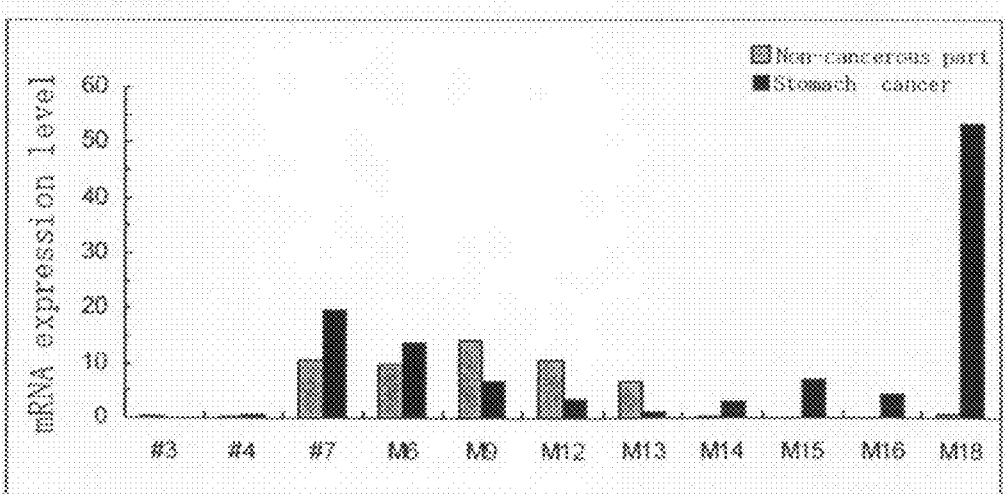
FIG. 28 shows the results of an expression analysis of a cancer-associated gene TEG26.

The PCR result showed that, an elevation in the expression of mRNA of TEG26 gene was observed clearly in the cancerous part in 4 cases out of 11 cases of the analyzed stomach cancer (FIG. 28).

Expression Analysis of TEG27

Gene expression was compared by an RT-PCR method using RNA prepared from 11 cases of stomach cancer tissue and normal stomach tissue in non-cancerous part of the same samples.

Figure 29:
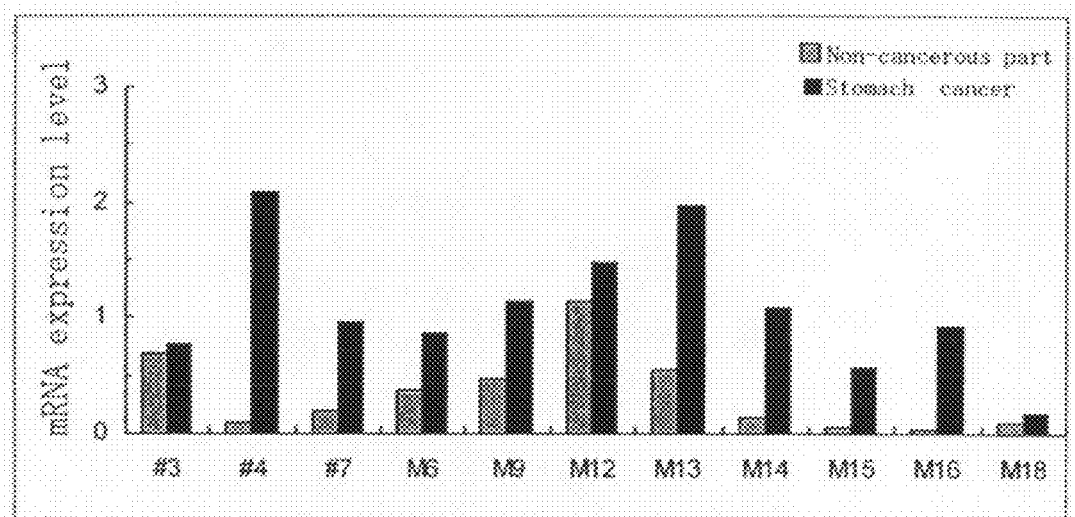
FIG. 29 shows the results of an expression analysis of a cancer-associated gene TEG27.

The PCR result showed that, an elevation in the expression of mRNA of TEG27 gene was observed clearly in the cancerous part in 8 cases out of 11 cases of the analyzed stomach cancer (FIG. 29).

Expression Analysis of TEG28

Gene expression was compared by an RT-PCR method using RNA prepared from 8 cases of stomach cancer tissue and normal stomach tissue in non-cancerous part of the same samples.

Figure 30:
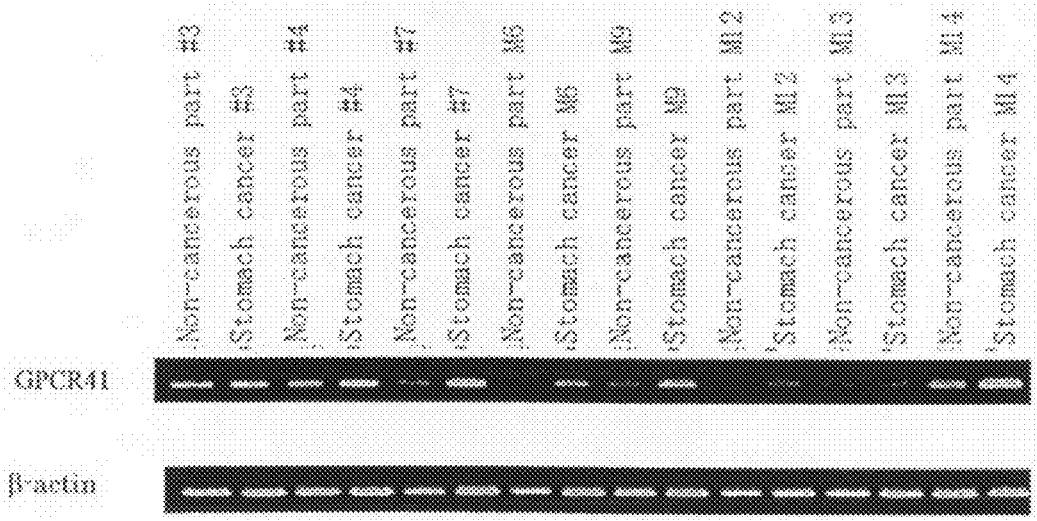
FIG. 30 shows the results of an expression analysis of a cancer-associated gene TEG28.

The PCR result showed that, an elevation in the expression of mRNA of TEG28 gene was observed clearly in the cancerous part in 5 cases out of 8 cases of the analyzed stomach cancer (FIG. 30).

Expression Analysis of TEG29

Gene expression was compared by a quantitative RT-PCR method using RNA prepared from 8 cases of lung adenocarcinoma tissue and 4 cases of normal lung tissue.

Figure 31:
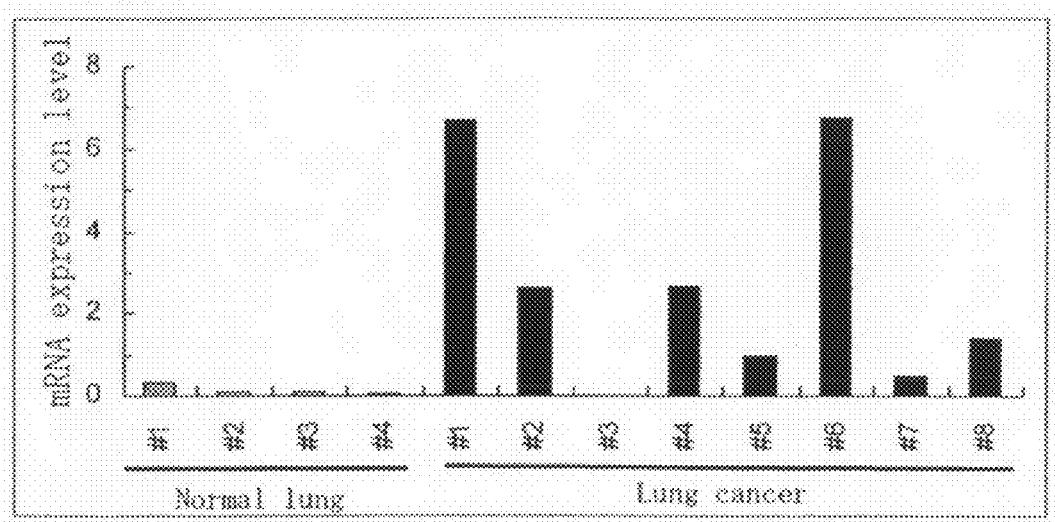
FIG. 31 shows the results of an expression analysis of a cancer-associated gene TEG29.

The PCR result showed that, while the expression of mRNA of TEG29 gene was not observed in the normal lung tissue, it was found that the expression of mRNA is clearly elevated in 7 cases out of the analyzed 8 cases of lung adenocarcinoma tissue (FIG. 31).

Expression Analysis of TEG30

Gene expression was compared by a quantitative RT-PCR method using RNA prepared from 12 cases of lung adenocarcinoma tissue and 4 cases of normal lung tissue.

Figure 32:
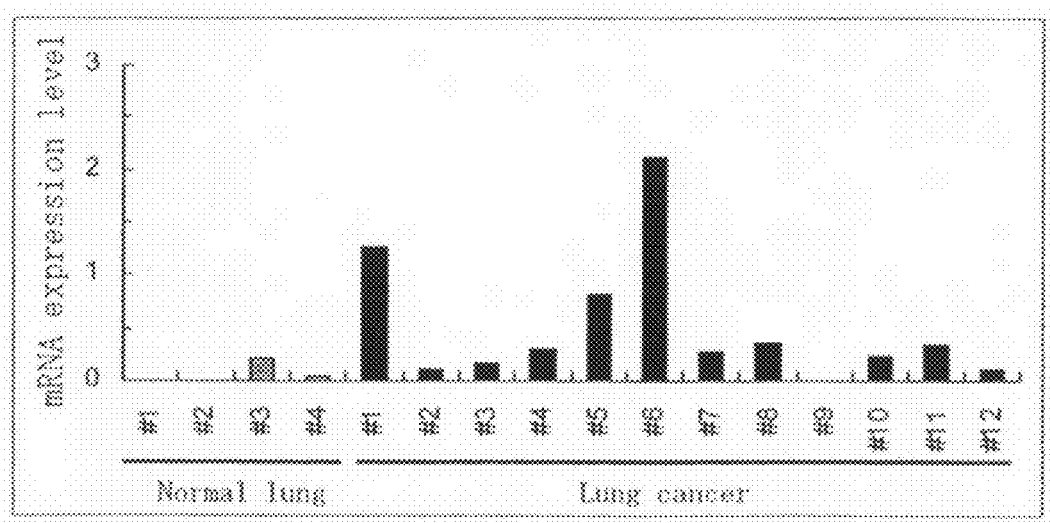
FIG. 32 shows the results of an expression analysis of a cancer-associated gene TEG30.

The PCR result showed that, while very little expression of mRNA of TEG30 gene was observed in the normal lung tissue, expression of mRNA was observed in 11 cases out of the analyzed 12 cases of lung adenocarcinoma tissue, and moreover, it was found that the expression of mRNA is clearly elevated in 4 cases out of the 11 cases compared with that of the normal lung (FIG. 32).

Expression Analysis of TEG31

Gene expression was compared by a quantitative RT-PCR method using RNA prepared from 12 cases of lung adenocarcinoma tissue and 4 cases of normal lung tissue.

Figure 33:
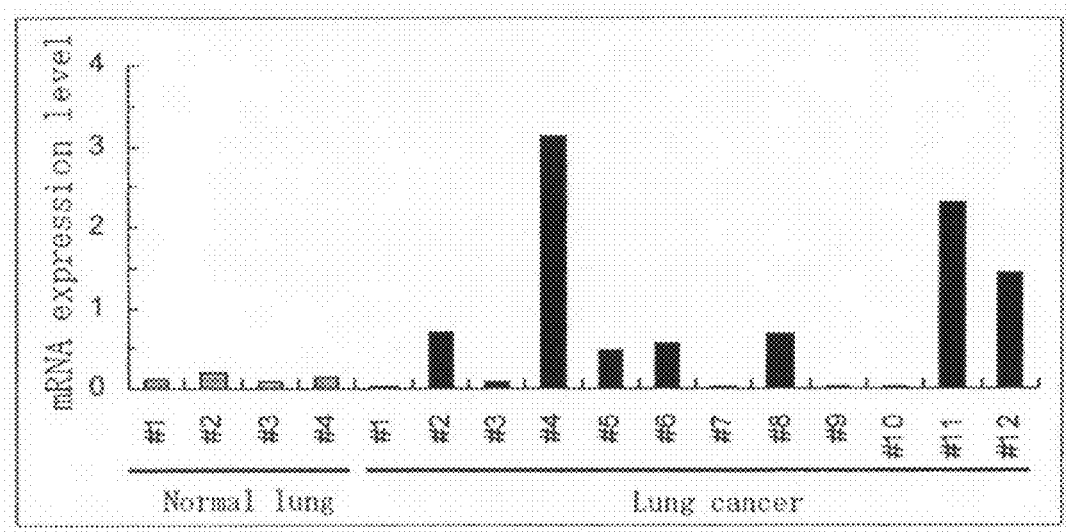
FIG. 33 shows the results of an expression analysis of a cancer-associated gene TEG31.

The PCR result showed that, while very little expression of mRNA of TEG31 gene was observed in the normal lung tissue, indicating that the expression of mRNA is clearly elevated in 7 cases out of the analyzed 12 cases of lung adenocarcinoma tissue (FIG. 33).

Expression Analysis of TEG32

Gene expression was compared by a quantitative RT-PCR method using RNA prepared from 12 cases of lung adenocarcinoma tissue and 4 cases of normal lung tissue.

Figure 34:
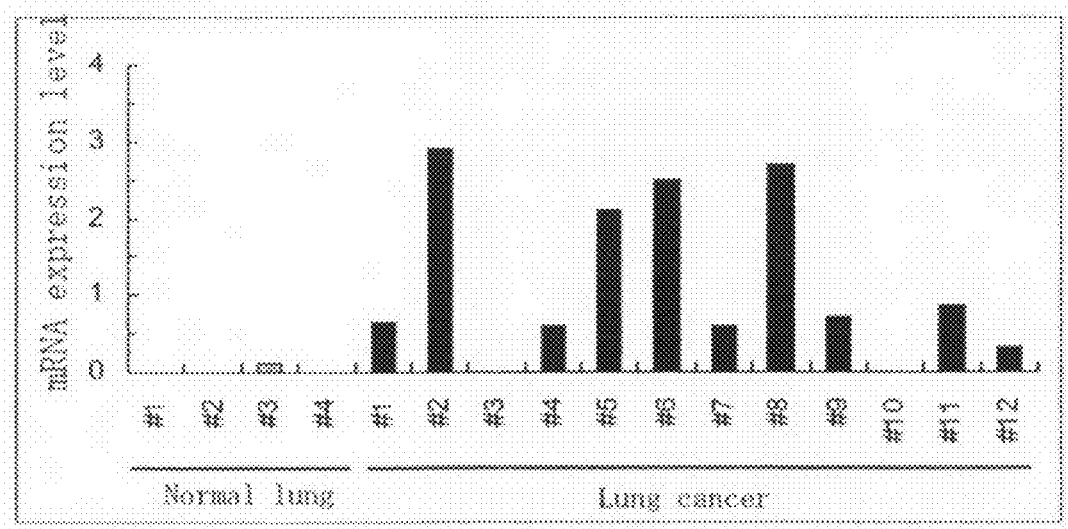
FIG. 34 shows the results of an expression analysis of a cancer-associated gene TEG32.

The PCR result showed that, while the expression of mRNA of TEG32 gene was not observed in the normal lung tissue, indicating that the expression of mRNA is clearly elevated in 4 cases out of the analyzed 12 cases of lung adenocarcinoma tissue (FIG. 34).

Expression Analysis of TEG33

Gene expression was compared by a quantitative RT-PCR method using RNA prepared from 12 cases of lung adenocarcinoma tissue and 4 cases of normal lung tissue.

Figures 35, 36:
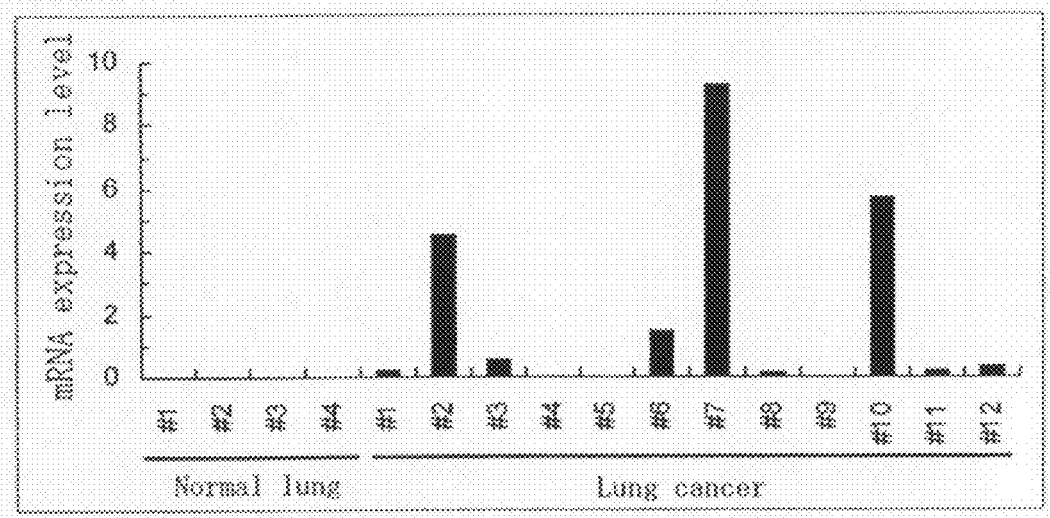
FIG. 35 shows the results of an expression analysis of a cancer-associated gene TEG33.
FIG. 36 shows the results of an expression analysis of a cancer-associated gene TEG34.

The PCR result showed that, while the expression of mRNA of TEG33 gene was not observed in the normal lung tissue, the expression of mRNA was observed in 9 cases out of the analyzed 12 cases of lung adenocarcinoma tissue, and in particular, extremely high expression of mRNA was observed in 4 cases (FIG. 35).

Expression Analysis of TEG34

Gene expression was compared by an RT-PCR method using RNA prepared from 11 cases of stomach cancer tissue and normal stomach tissue in non-cancerous part of the same samples.

The PCR result showed that, an elevation in the expression of mRNA of TEG34 gene was observed clearly in the cancerous part in 8 cases out of the analyzed 11 cases (FIG. 36).

Expression Analysis of TEG35

Gene expression was compared by an RT-PCR method using RNA prepared from 11 cases of stomach cancer tissue and normal stomach tissue in non-cancerous part of the same samples.

Figure 37:
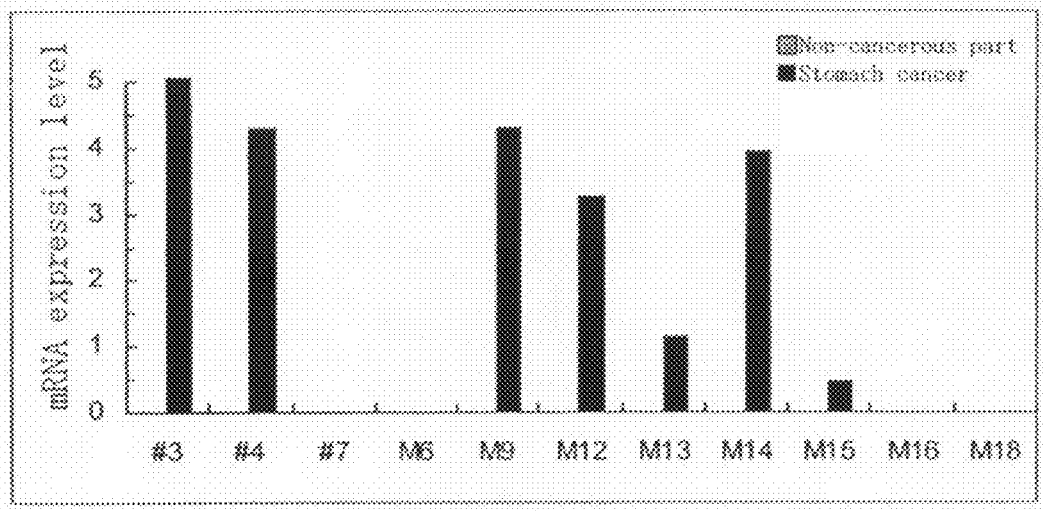
FIG. 37 shows the results of an expression analysis of a cancer-associated gene TEG35.

The PCR result showed that, an elevation in the expression of mRNA of TEG35 gene was observed clearly in the cancerous part in 7 cases out of the analyzed 11 cases (FIG. 37).

Expression Analysis of TEG36

Gene expression was compared by an RT-PCR method using RNA prepared from 11 cases of stomach cancer tissue and normal stomach tissue in non-cancerous part of the same samples.

Figure 38:
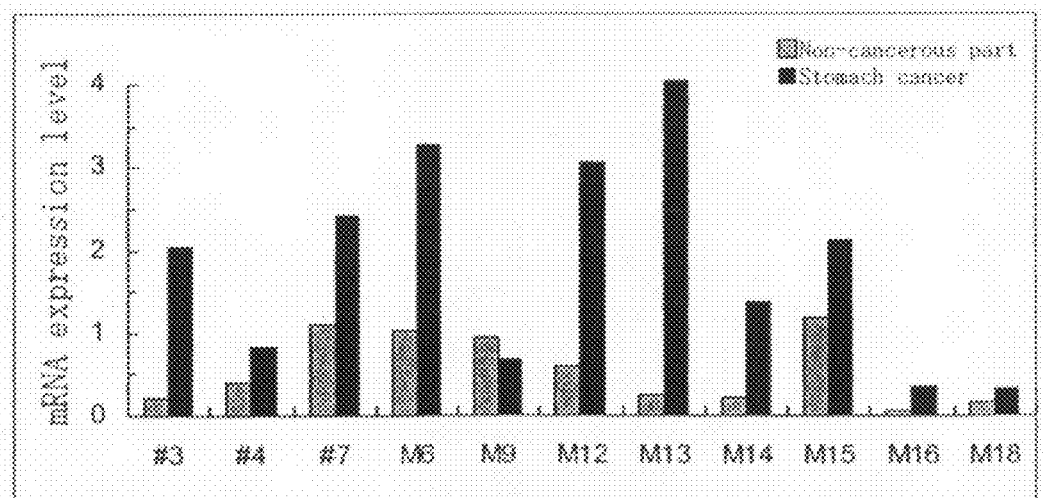
FIG. 38 shows the results of an expression analysis of a cancer-associated gene TEG36.

The PCR result showed that, an elevation in the expression of mRNA of TEG36 gene was observed clearly in the cancerous part in 8 cases out of the analyzed 11 cases (FIG. 38).

Expression Analysis of TEG37

Gene expression was compared by an RT-PCR method using RNA prepared from 11 cases of stomach cancer tissue and normal stomach tissue in non-cancerous part of the same samples.

Figure 39:
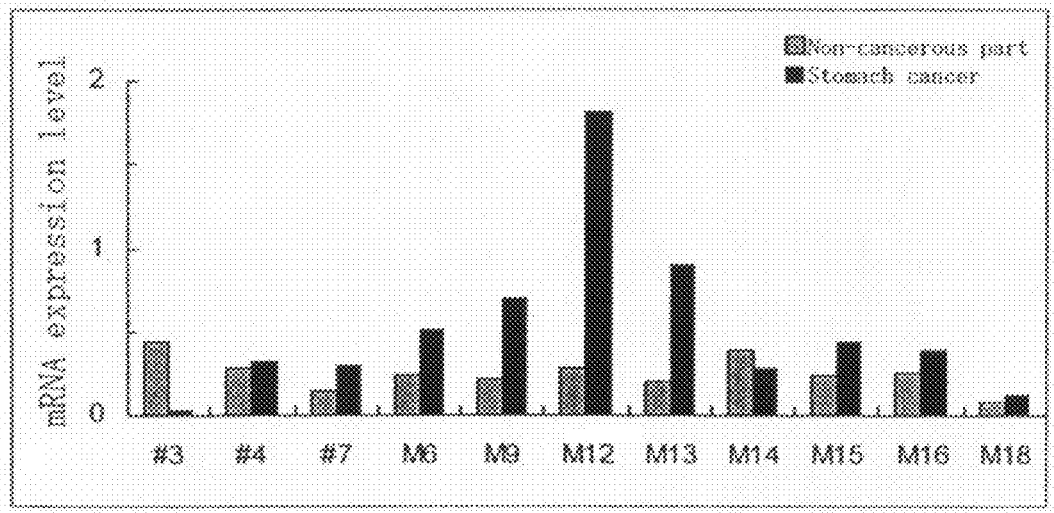
FIG. 39 shows the results of an expression analysis of a cancer-associated gene TEG37.

The PCR result showed that, an elevation in the expression of mRNA of TEG37 gene was observed clearly in the cancerous part in 7 cases out of the analyzed 11 cases (FIG. 39).

Expression Analysis of TEG38

Gene expression was compared by an RT-PCR method using RNA prepared from 11 cases of stomach cancer tissue and normal stomach tissue in non-cancerous part of the same samples.

Figure 40:
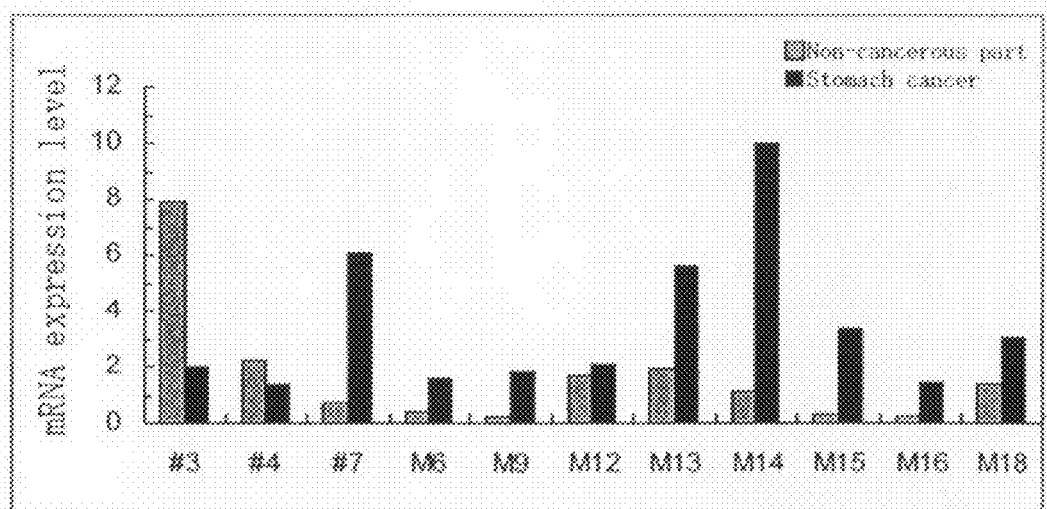
FIG. 40 shows the results of an expression analysis of a cancer-associated gene TEG38.

The PCR result showed that, an elevation in the expression of mRNA of TEG38 gene was observed clearly in the cancerous part in 8 cases out of the analyzed 11 cases (FIG. 40).

Expression Analysis of TEG39

Gene expression was compared by an RT-PCR method using RNA prepared from 11 cases of stomach cancer tissue and normal stomach tissue in non-cancerous part of the same samples.

Figure 41:
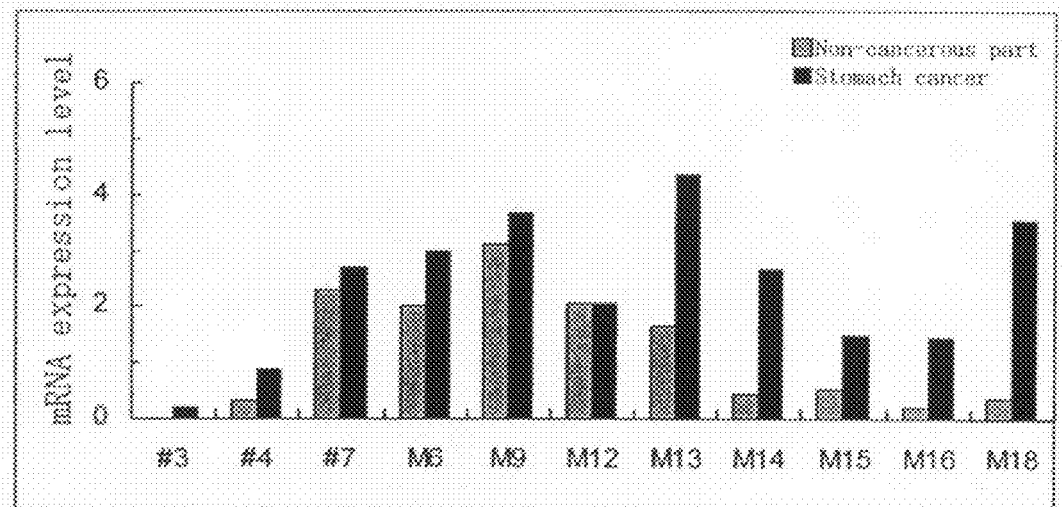
FIG. 41 shows the results of an expression analysis of a cancer-associated gene TEG39.

The PCR result showed that, a tendency that mRNA of TEG39 gene is overexpressed in the analyzed cancerous part was observed as a whole, and in particular, an elevation in the expression of mRNA was observed in the cancerous part in 6 cases out of 11 cases (FIG. 41).

Expression Analysis of TEG40

Gene expression was compared by an RT-PCR method using RNA prepared from 11 cases of stomach cancer tissue and normal stomach tissue in non-cancerous part of the same samples.

Figure 42:
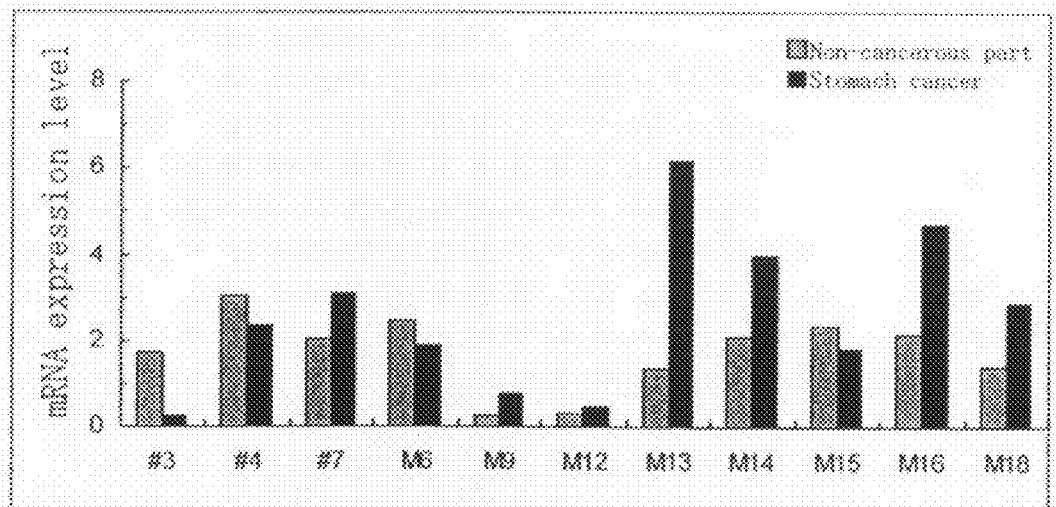
FIG. 42 shows the results of an expression analysis of a cancer-associated gene TEG40.

The PCR result showed that, an elevation in the expression of mRNA of TEG40 gene was observed clearly in the cancerous part in 4 cases out of the analyzed 11 cases (FIG. 42).

Expression Analysis of TEG41

Gene expression was compared by an RT-PCR method using RNA prepared from 11 cases of stomach cancer tissue and normal stomach tissue in non-cancerous part of the same samples.

Figure 43:
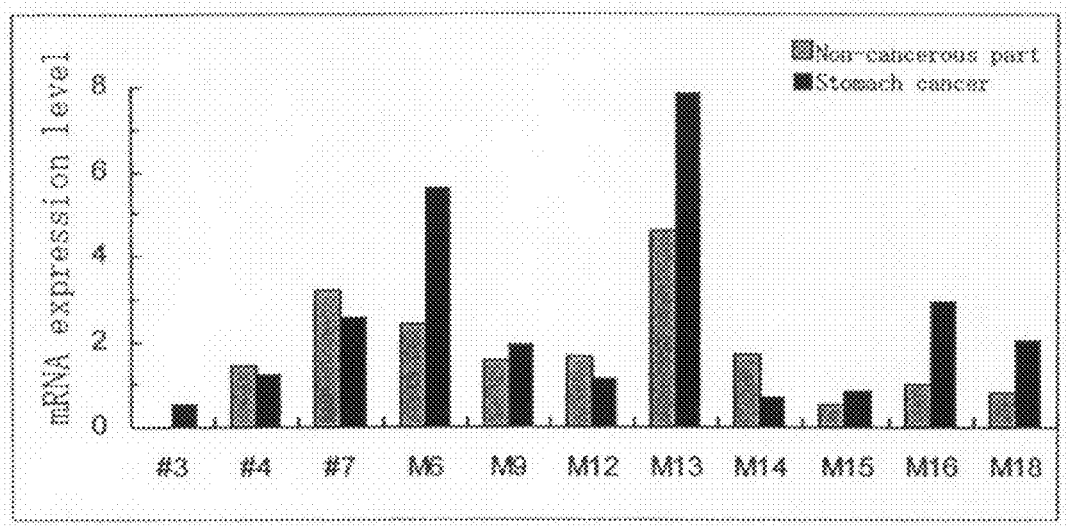
FIG. 43 shows the results of an expression analysis of a cancer-associated gene TEG41.

The PCR result showed that, an elevation in the expression of mRNA of TEG41 gene was observed clearly in the cancerous part in 4 cases out of the analyzed 11 cases (FIG. 43).

Expression Analysis of TEG42

Gene expression was compared by an RT-PCR method using RNA prepared from 11 cases of stomach cancer tissue and normal stomach tissue in non-cancerous part of the same samples.

Figure 44:
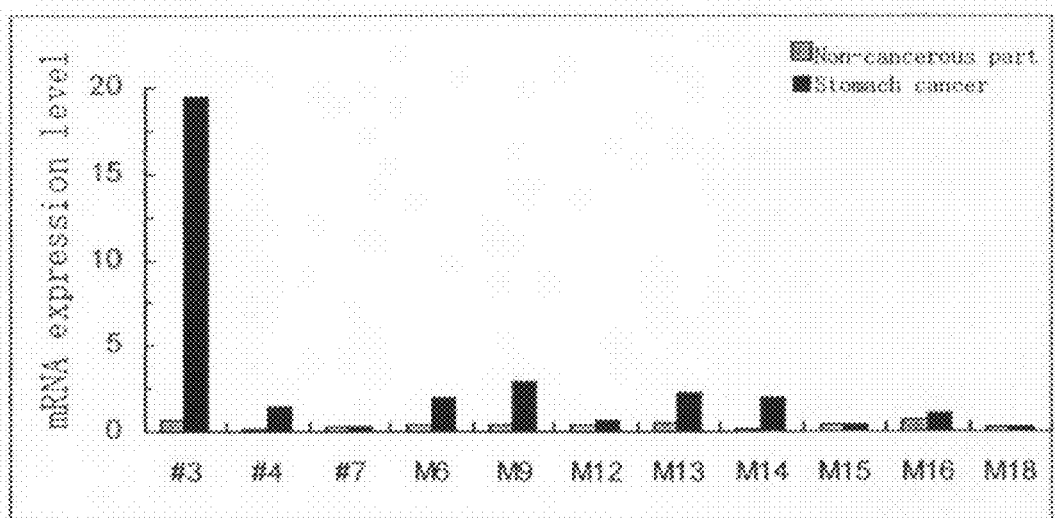
FIG. 44 shows the results of an expression analysis of a cancer-associated gene TEG42.

The PCR result showed that, while the expression of mRNA of TEG42 gene was low as a whole in the normal stomach, an elevation in the expression of mRNA was observed clearly in the cancerous part in 6 cases out of the analyzed 11 cases (FIG. 44).

Expression Analysis of TEG43

Gene expression was compared by an RT-PCR method using RNA prepared from 11 cases of stomach cancer tissue and normal stomach tissue in non-cancerous part of the same samples.

Figure 45:
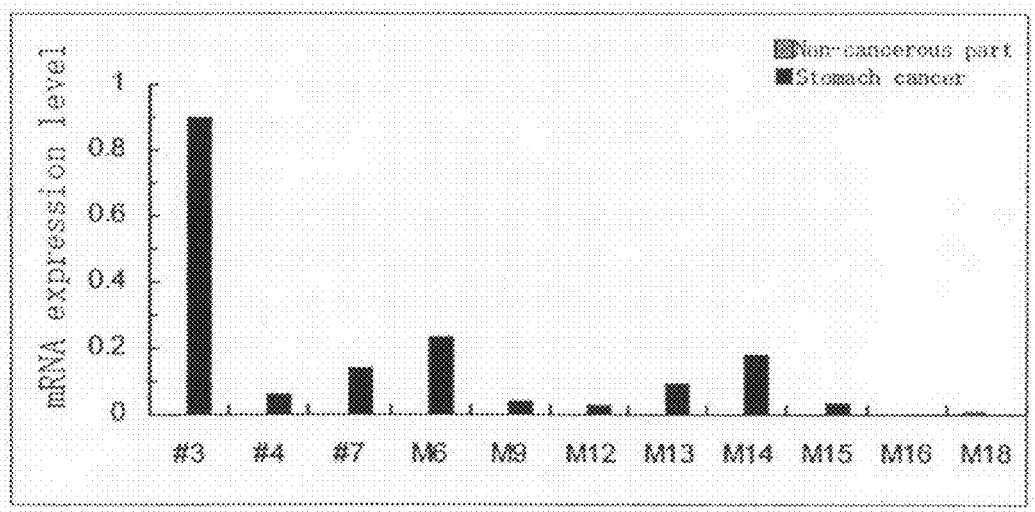
FIG. 45 shows the results of an expression analysis of a cancer-associated gene TEG43.

The PCR result showed that, while very little expression of mRNA of TEG43 gene was observed in the normal stomach, the expression of mRNA was observed in the cancerous part in 9 cases out of the analyzed 11 cases (FIG. 45).

Expression Analysis of TEG44

Gene expression was compared by an RT-PCR method using RNA prepared from 9 cases of liver cancer tissue and non-cancerous part of the same samples.

Figure 46:
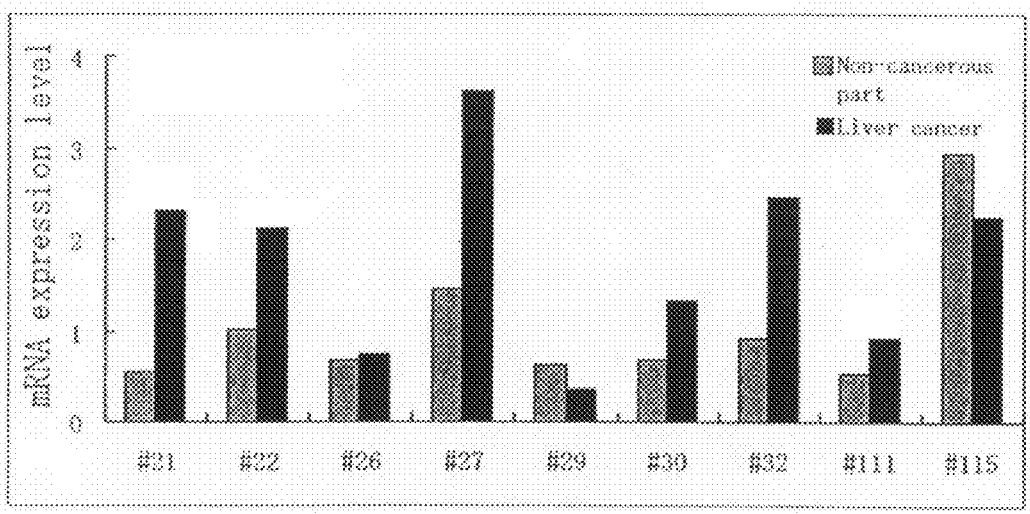
FIG. 46 shows the results of an expression analysis of a cancer-associated gene TEG44.

The PCR result showed that, an elevation in the expression of mRNA of TEG44 gene was observed clearly in the cancerous part in 5 cases out of 9 cases of the analyzed liver cancer (FIG. 46).

Expression Analysis of TEG45

Gene expression was compared by an RT-PCR method using RNA prepared from 11 cases of liver cancer tissue and non-cancerous part of the same samples.

Figure 47:
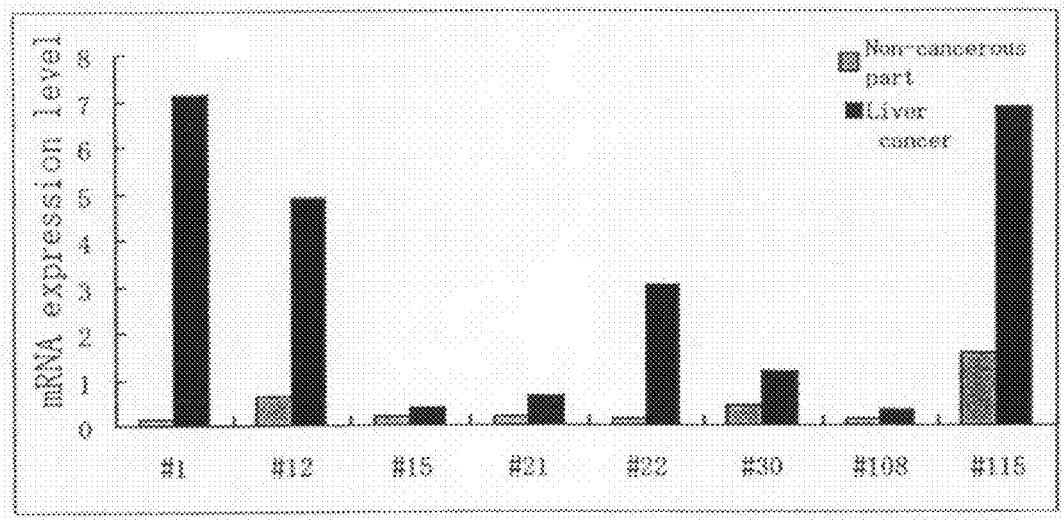
FIG. 47 shows the results of an expression analysis of a cancer-associated gene TEG45.

The PCR result showed that, an elevation in the expression of mRNA of TEG45 gene was observed clearly in the cancerous part in 7 cases out of 11 cases of the analyzed liver cancer (FIG. 47).

Expression Analysis of TEG46

Gene expression was compared by an RT-PCR method using RNA prepared from 9 cases of liver cancer tissue and non-cancerous part of the same samples.

Figure 48:
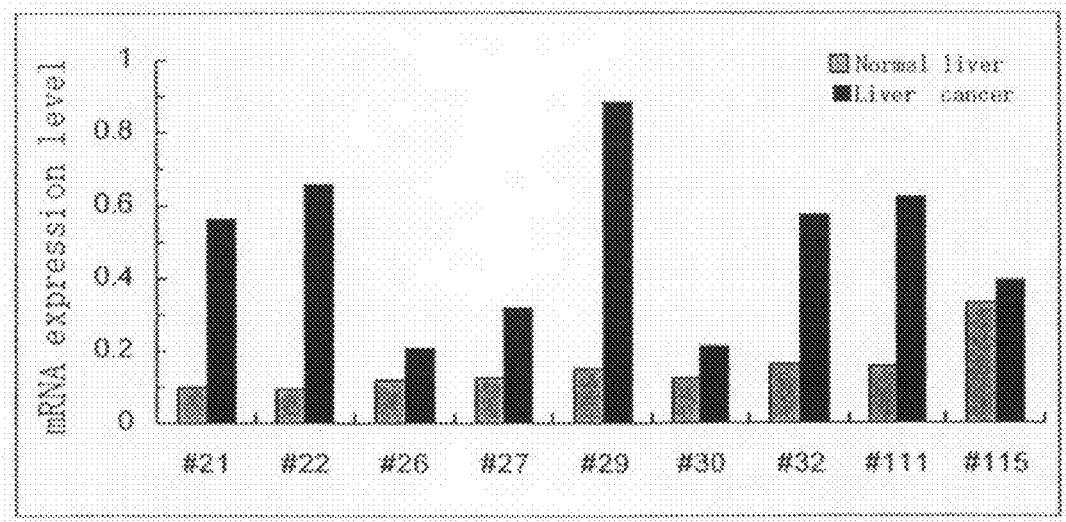
FIG. 48 shows the results of an expression analysis of a cancer-associated gene TEG46.

The PCR result showed that, the expression level of mRNA of TEG46 gene showed a higher value in the cancerous part in all the 9 cases of the analyzed liver cancer and in particular, a significant elevation in the expression of mRNA was observed in the cancerous part in 6 cases (FIG. 48).

Expression Analysis of TEG47

Gene expression was compared by a quantitative RT-PCR method using RNA prepared from 10 cases of large bowel cancer tissue and normal large bowel tissue in non-cancerous part of the same samples.

Figure 49:
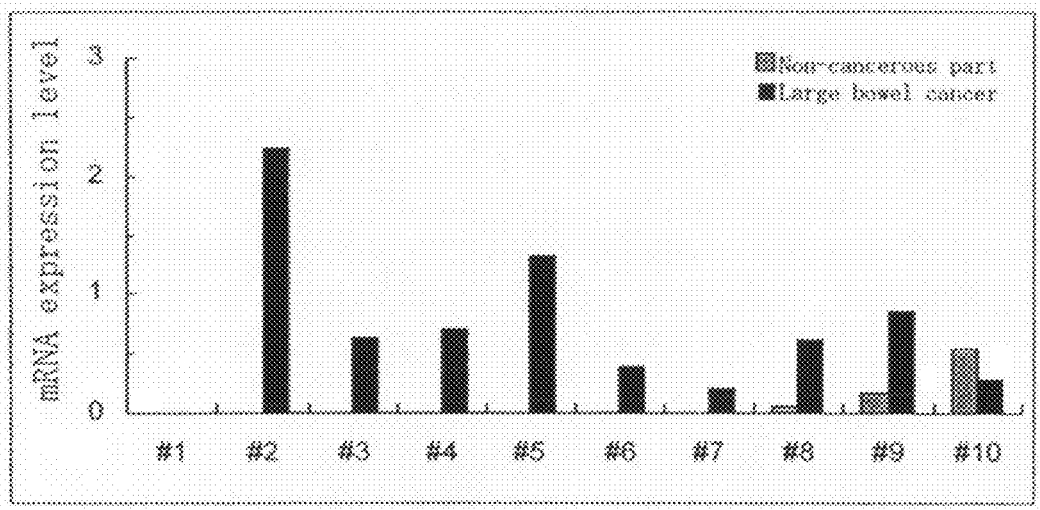
FIG. 49 shows the results of an expression analysis of a cancer-associated gene TEG47.

The PCR result showed that, an elevation in the expression of mRNA of TEG47 gene was observed clearly in the cancerous part compared with that in the normal large bowel tissue in the samples of 8 cases out of the analyzed 10 cases (FIG. 49).

Expression Analysis of TEG48

Gene expression was compared by an RT-PCR method using RNA prepared from 10 cases of large bowel cancer tissue and normal large bowel tissue in non-cancerous part of the same samples.

Figure 50:
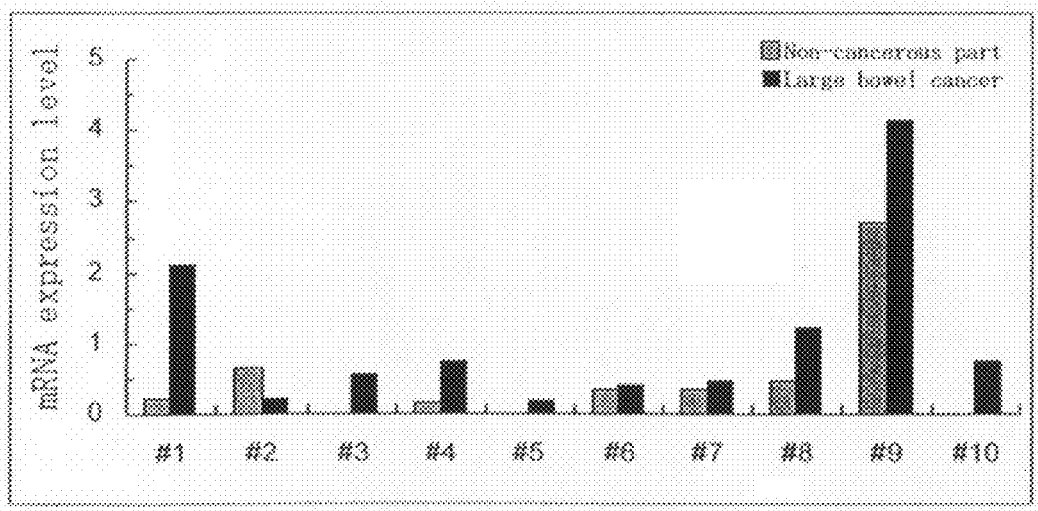
FIG. 50 shows the results of an expression analysis of a cancer-associated gene TEG48.

The PCR result showed that, an elevation in the expression of mRNA of TEG48 gene was observed in the cancerous part in 9 cases out of the analyzed 10 cases (FIG. 50).

Expression Analysis of TEG49

Gene expression was compared by a quantitative RT-PCR method using RNA prepared from 6 cases of large bowel cancer tissue and normal large bowel tissue in non-cancerous part of the same samples.

Figure 51:
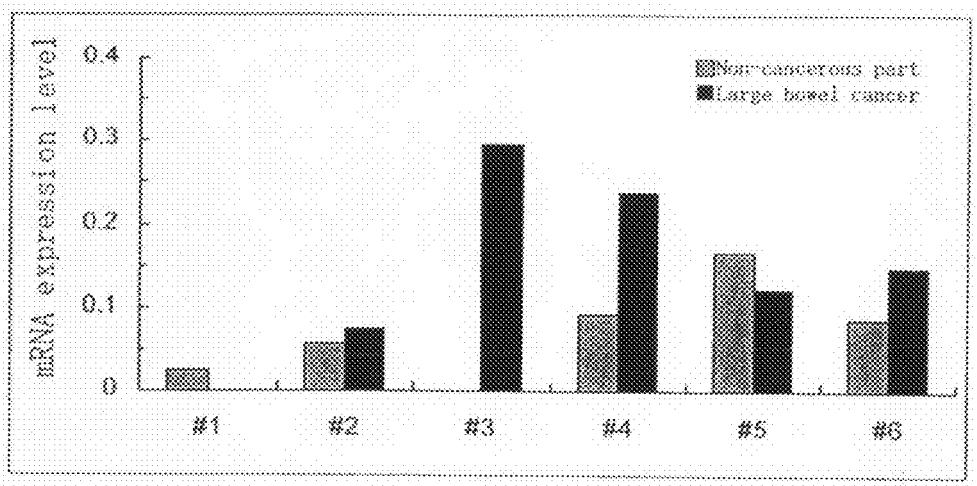
FIG. 51 shows the results of an expression analysis of a cancer-associated gene TEG49.

The PCR result showed that, the expression of mRNA of TEG49 gene is elevated in the cancerous part compared with that in the non-cancerous part in 3 cases out of the analyzed 6 cases (FIG. 51).

Expression Analysis of TEG50

Gene expression was compared by an RT-PCR method using RNA prepared from 6 cases of large bowel cancer tissue and normal large bowel tissue in non-cancerous part of the same samples.

Figure 52:
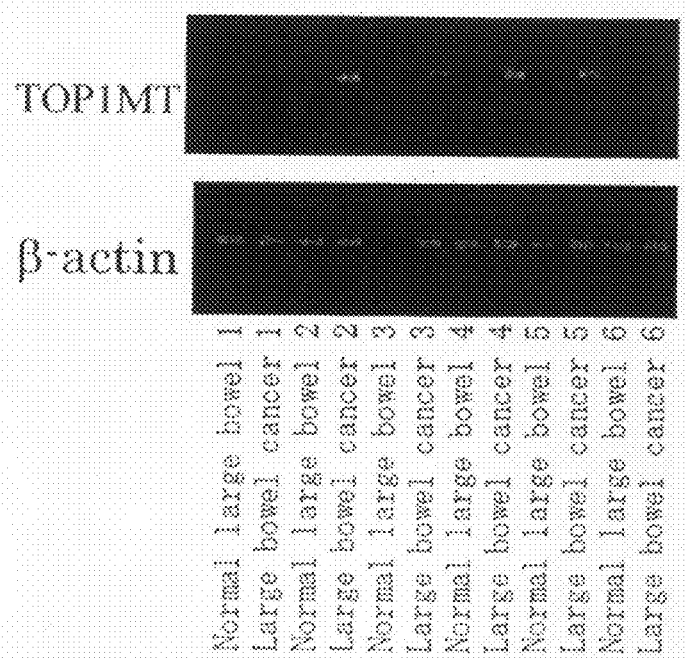
FIG. 52 shows the results of an expression analysis of a cancer-associated gene TEG50.

The PCR result showed that, while amplification of a band derived from TEG50 was not observed in the normal large bowel tissue in all the analyzed 6 cases, amplification of the band was observed in the cancerous part in 4 cases out of 6 cases, indicating that the expression of mRNA is elevated in the cancerous part (FIG. 52).

Expression Analysis of TEG51

Gene expression was compared by an RT-PCR method using RNA prepared from 6 cases of large bowel cancer tissue and normal large bowel tissue in non-cancerous part of the same samples.

Figure 53:
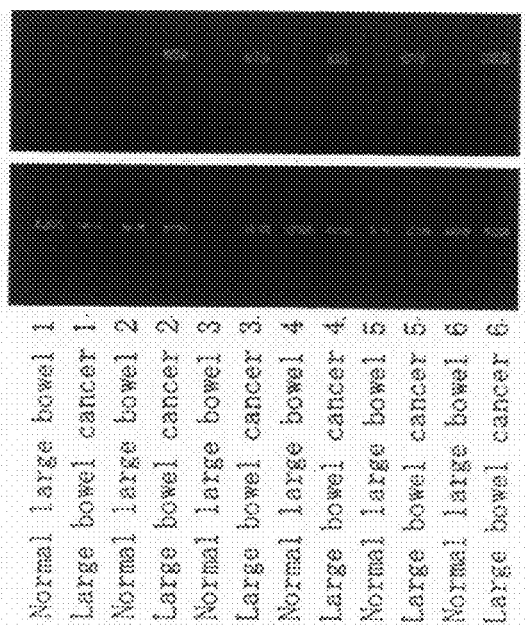
FIG. 53 shows the results of an expression analysis of a cancer-associated gene TEG51.

The PCR result showed that, while amplification of mRNA of TEG51 gene by PCR was not observed in any of the normal large bowel tissue, amplification of TEG51 gene was clearly observed in 5 cases out of the analyzed 6 cases of large bowel tissue, indicating that the expression of mRNA is elevated in large bowel cancer (FIG. 53).

Expression Analysis of TEG52

Gene expression was compared by a quantitative RT-PCR method using RNA prepared from 12 cases of lung adenocarcinoma tissue and 4 cases of normal lung tissue.

Figure 54:
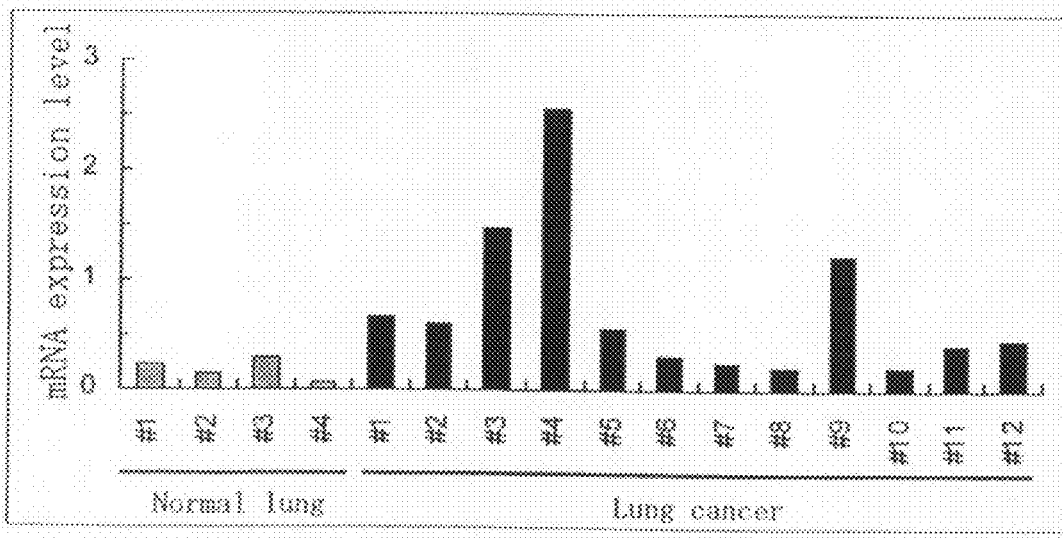
FIG. 54 shows the results of an expression analysis of a cancer-associated gene TEG52.

The PCR result showed that, the expression of mRNA of TEG52 gene is elevated clearly in lung cancer in 7 cases out of the analyzed 12 cases compared with that in the normal lung tissue (FIG. 54).

Expression Analysis of TEG53

Gene expression was compared by a quantitative RT-PCR method using RNA prepared from 8 cases of lung adenocarcinoma tissue and 4 cases of normal lung tissue.

Figure 55:
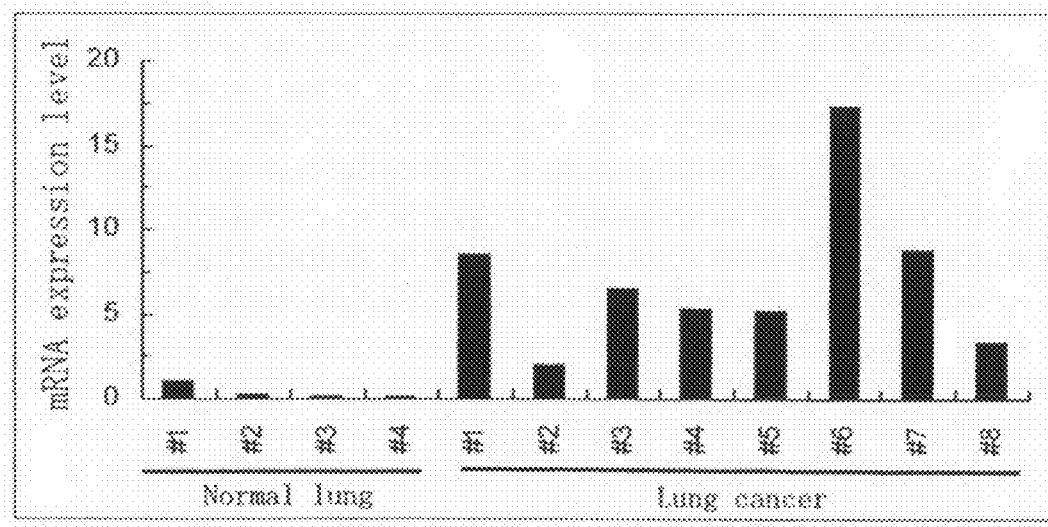
FIG. 55 shows the results of an expression analysis of a cancer-associated gene TEG53.

The PCR result showed that, while the expression of mRNA of TEG53 gene was not observed in the normal lung tissue, an elevation in the expression of mRNA was observed in all the analyzed 8 cases of lung adenocarcinoma tissue (FIG. 55).

Expression Analysis of TEG54

Gene expression was compared by an RT-PCR method using RNA prepared from 11 cases of stomach cancer tissue and normal stomach tissue in non-cancerous part of the same samples.

Figure 56:
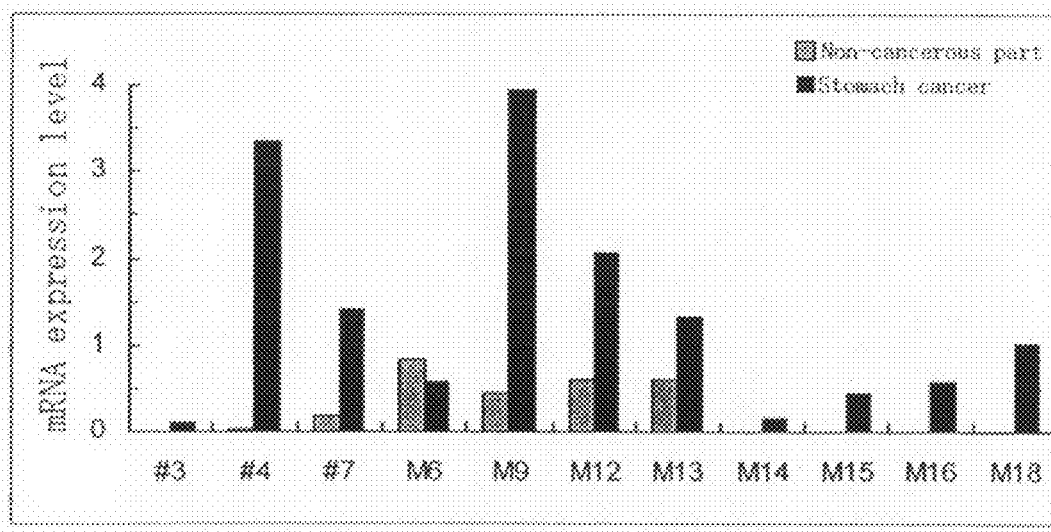
FIG. 56 shows the results of an expression analysis of a cancer-associated gene TEG54.

The PCR result showed that, an elevation in the expression of mRNA of TEG54 gene was observed clearly in the cancerous part in 9 cases out of the analyzed 11 cases (FIG. 56).

Expression Analysis of TEG55

Gene expression was compared by an RT-PCR method using RNA prepared from 11 cases of stomach cancer tissue and normal stomach tissue in non-cancerous part of the same samples.

Figure 57:
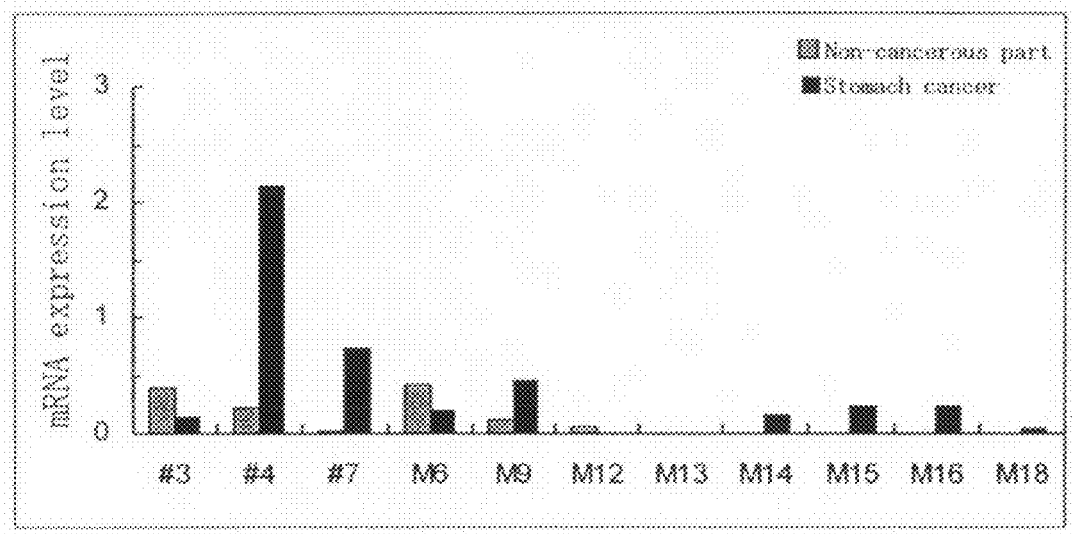
FIG. 57 shows the results of an expression analysis of a cancer-associated gene TEG55.

The PCR result showed that, an elevation in the expression of mRNA of TEG55 gene was observed clearly in the cancerous part in 6 cases out of the analyzed 11 cases (FIG. 57).

Expression Analysis of TEG56

Gene expression was compared by an RT-PCR method using RNA prepared from 11 cases of stomach cancer tissue and normal stomach tissue in non-cancerous part of the same samples.

Figure 58:
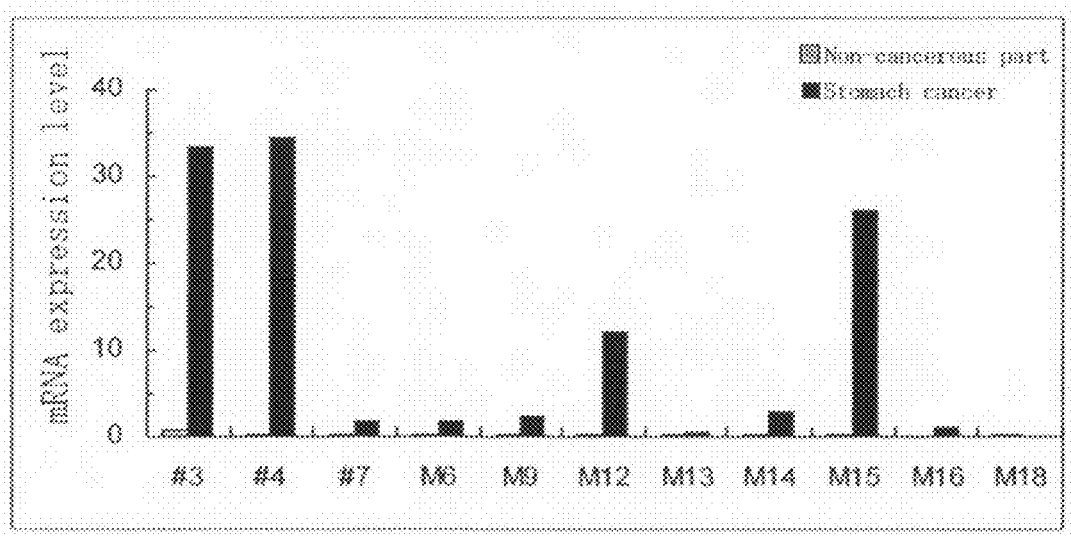
FIG. 58 shows the results of an expression analysis of a cancer-associated gene TEG56.

The PCR result showed that, while the expression of mRNA of TEG56 gene was low as a whole in the normal stomach, an elevation in the expression of mRNA was observed clearly in the cancerous part in 9 cases out of the analyzed 11 cases (FIG. 58).

Expression Analysis of TEG57

Gene expression was compared by an RT-PCR method using RNA prepared from 9 cases of liver cancer tissue and non-cancerous part of the same samples.

Figure 59:
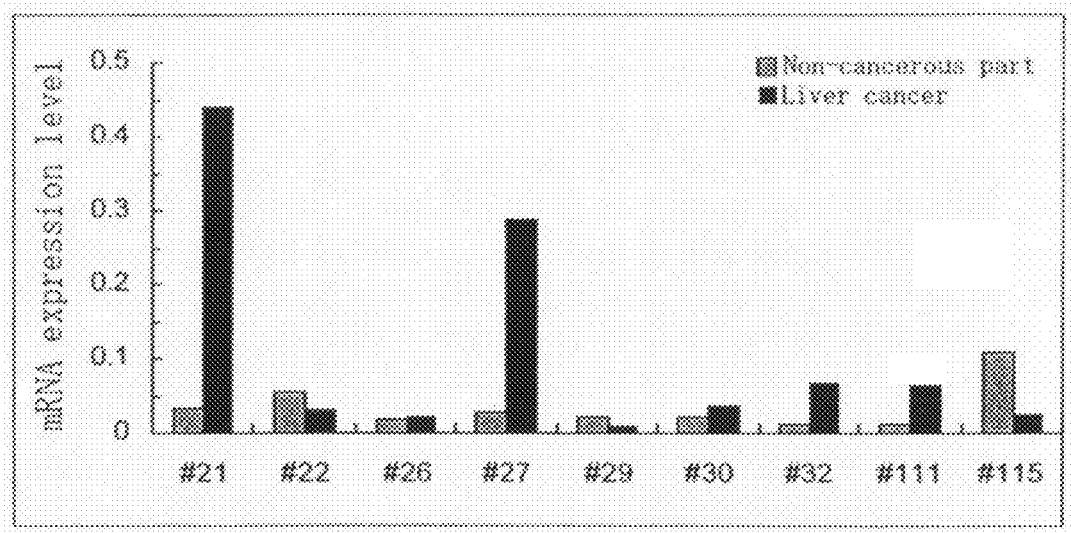
FIG. 59 shows the results of an expression analysis of a cancer-associated gene TEG57.

The PCR result showed that, an elevation in the expression of mRNA of TEG57 gene was observed clearly in the cancerous part in 5 cases out of the analyzed 9 cases of liver cancer (FIG. 59).

Expression Analysis of TEG58

Gene expression was compared by an RT-PCR method using RNA prepared from 9 cases of liver cancer tissue and non-cancerous part of the same samples.

Figure 60:
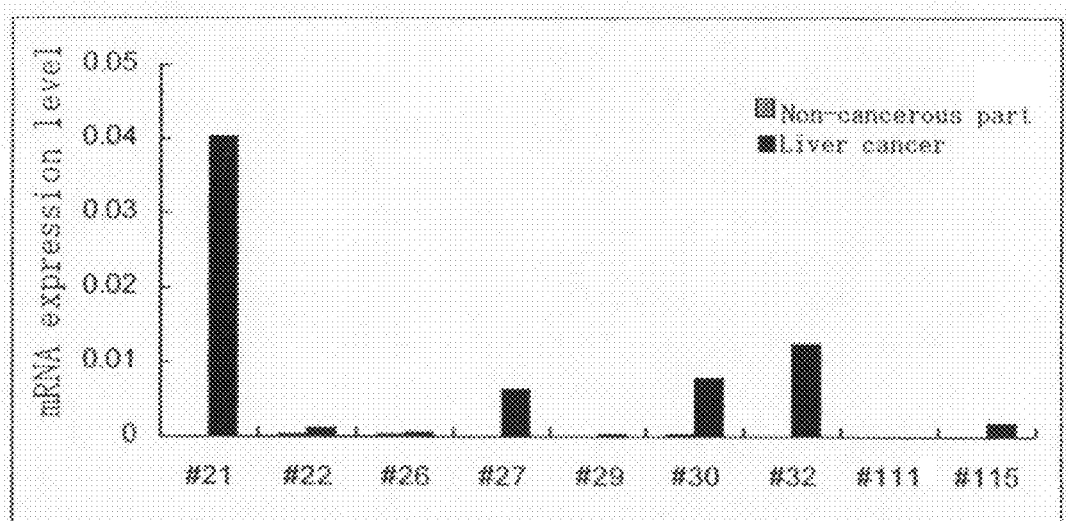
FIG. 60 shows the results of an expression analysis of a cancer-associated gene TEG58.

The PCR result showed that, an elevation in the expression of mRNA of TEG58 gene was observed clearly in the cancerous part in 5 cases out of the analyzed 9 cases of liver cancer (FIG. 60).

Expression Analysis of TEG59

Gene expression was compared by an RT-PCR method using RNA prepared from 9 cases of liver cancer tissue and non-cancerous part of the same samples.

Figure 61:
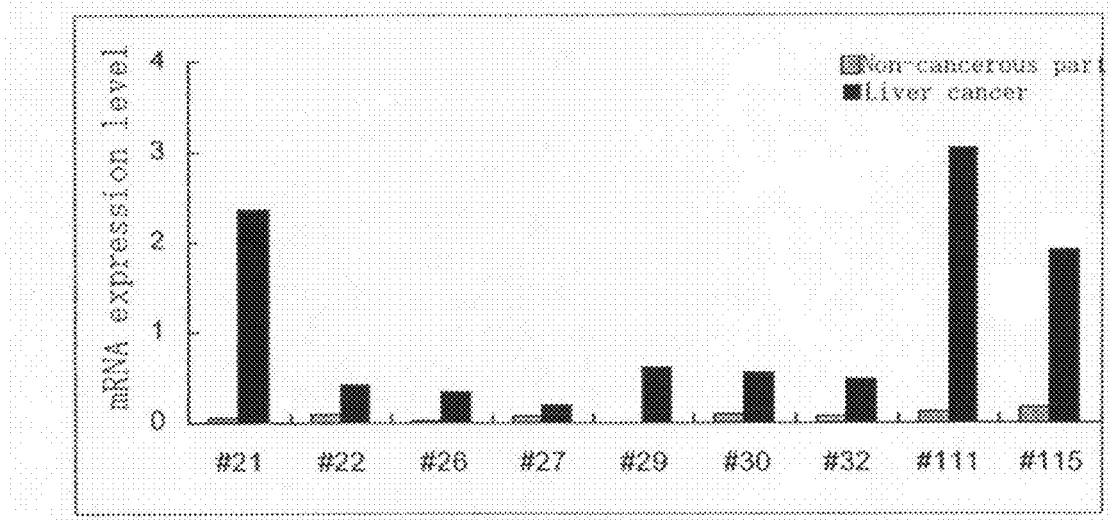
FIG. 61 shows the results of an expression analysis of a cancer-associated gene TEG59.

The PCR result showed that, while the expression level of mRNA of TEG59 gene was little as a whole in 9 cases of the analyzed non-cancerous part, an elevation in the expression of mRNA was observed clearly in the cancerous part in all the analyzed 9 cases of liver cancer (FIG. 61).

Expression Analysis of TEG60

Gene expression was compared by an RT-PCR method using RNA prepared from 9 cases of hepatoblastoma tissue and 2 cases of normal liver.

Figure 62:
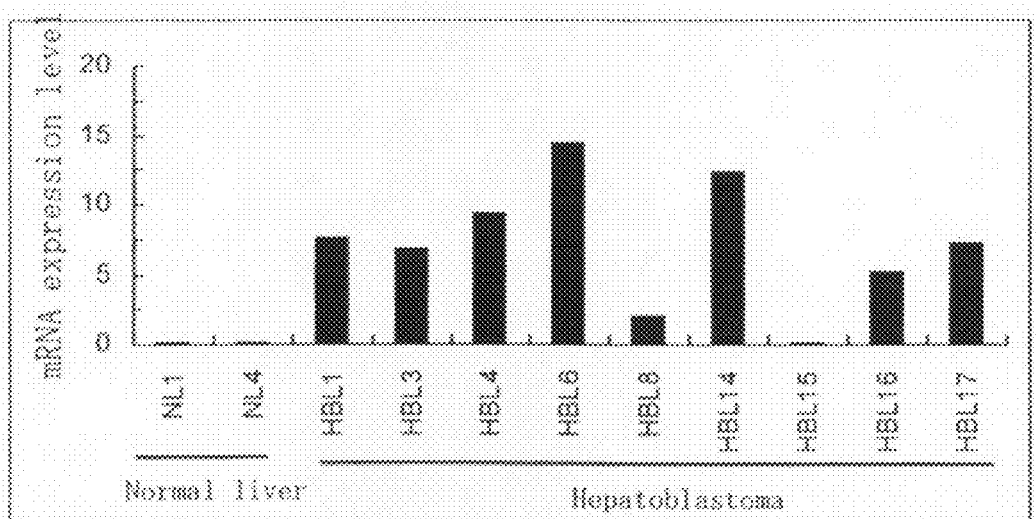
FIG. 62 shows the results of an expression analysis of a cancer-associated gene TEG60.

The PCR result showed that, while very little expression of mRNA of TEG60 gene was observed in the analyzed normal liver, an elevation in the expression of mRNA was observed clearly in 8 cases out of the analyzed 9 cases of hepatoblastoma (FIG. 62).

Expression Analysis of TEG61

Gene expression was compared by a quantitative RT-PCR method using RNA prepared from 12 cases of lung adenocarcinoma tissue and 4 cases of normal lung tissue.

Figures 63, 64:
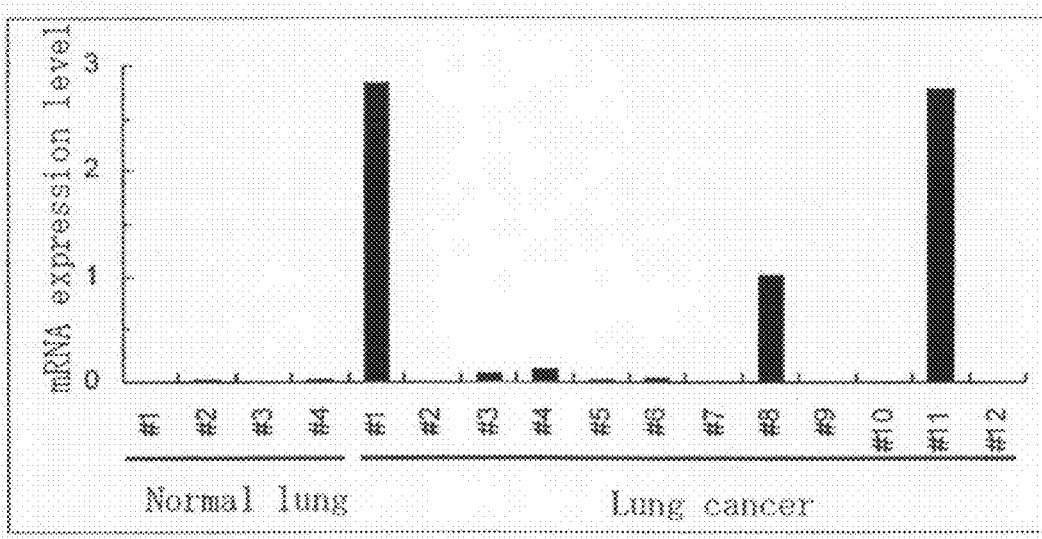
FIG. 63 shows the results of an expression analysis of a cancer-associated gene TEG61.
FIG. 64 shows the results of an expression analysis of a cancer-associated gene TEG62.

The result showed that, while the expression of mRNA of TEG61 gene was not observed in the normal lung tissue, overexpression of the PAEP gene was observed in 3 cases out of the analyzed 12 cases of lung adenocarcinoma tissue (FIG. 63).

Expression Analysis of TEG62

Gene expression was compared by a quantitative RT-PCR method using RNA prepared from 12 cases of lung adenocarcinoma tissue and 4 cases of normal lung tissue.

The PCR result showed that, the expression of mRNA of TEG62 gene is clearly elevated in 8 cases out of the analyzed 12 cases of lung adenocarcinoma tissue compared with the expression in the normal lung tissue (FIG. 64).

Expression Analysis of TEG63

Gene expression was compared by an RT-PCR method using RNA prepared from 9 cases of liver cancer tissue and non-cancerous part of the same samples.

Figure 65:
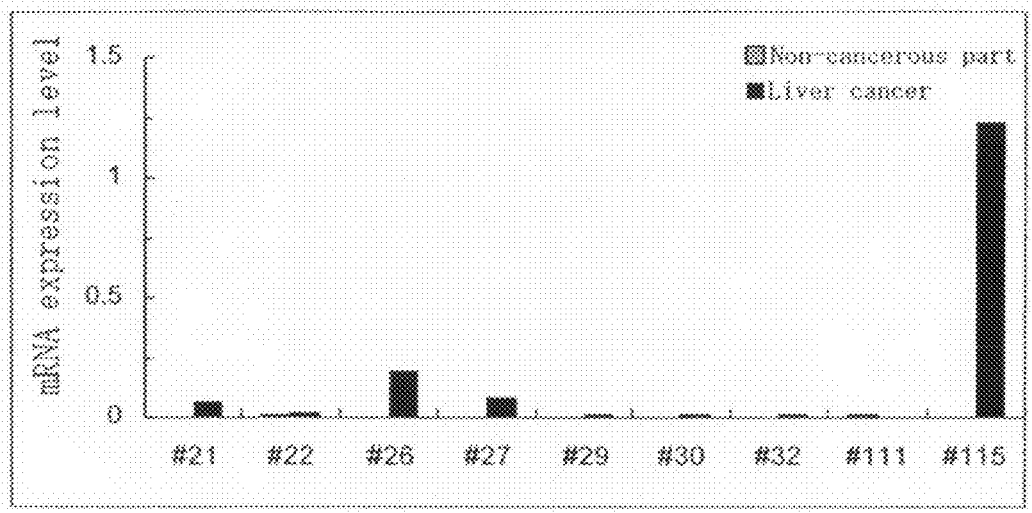
FIG. 65 shows the results of an expression analysis of a cancer-associated gene TEG63.

The PCR result showed that, while very little expression of mRNA of TEG63 gene was observed in the non-cancerous part in the analyzed 9 cases, an elevation in the expression of mRNA was observed clearly in 8 cases out of the analyzed 9 cases of liver cancer (FIG. 65).

Expression Analysis of TEG64

Gene expression was compared by an RT-PCR method using RNA prepared from 9 cases of liver cancer tissue and non-cancerous part of the same samples.

Figure 66:
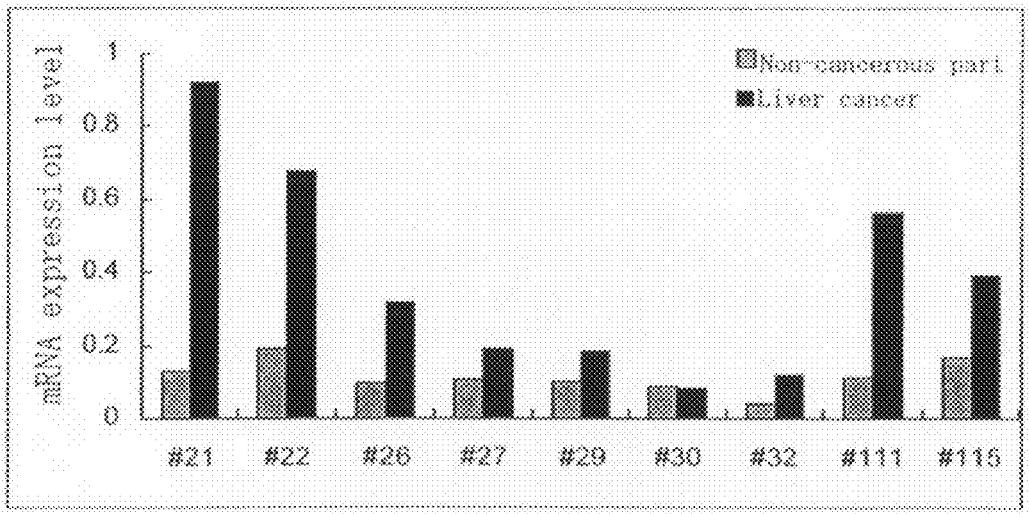
FIG. 66 shows the results of an expression analysis of a cancer-associated gene TEG64.

The PCR result showed that, an elevation in the expression of mRNA of TEG64 gene was observed clearly in the cancerous part in 8 cases out of the analyzed 9 cases of liver cancer (FIG. 66).

The above results revealed that these genes can be used in diagnosis of cancer by measuring the expression level of the genes or proteins.

Example 3

Isolation and Identification of Full-length cDNA for TEG12 Gene Expressed in Liver Cancer cDNA was isolated and identified to determine the cDNA sequence of TEG12 whose expression was found to be elevated in liver cancer in the above-mentioned Gene chip analysis and RT-PCR analysis.

More specifically, the sequence of the EST (GenBank; BU844373) located near the EST (GenBank; BF057073: SEQ ID NO: 254), used as the origin of the probe sequence in the Gene chip analysis, was obtained from GenBank. Primers to be hybridized to each EST were designed and cDNA was amplified by PCR. PCR was carried out by using a single-stranded cDNA prepared from an equal amount of each RNA prepared from Hep3B, HuH6 and HepG2, which are human liver cancer cell lines, as a template and each 5 pmole of PCR primers LS557 (ATCCGCCAGG TGAAAGCCAA GTC: SEQ ID NO: 255) and LS589 (GGGATTCACA TTAC-CACGGC AGTGC: SEQ ID NO: 256). PCR was carried out by using an LA-PCR kit (manufactured by TAKARA) for 35 cycles of 94° C. for 30 seconds, 63° C. for 30 seconds and 72° C. for 5 minutes. A band of about 2000 bp was amplified. The PCR amplification product was inserted into pGEM-T Easy vector (manufactured by Promega), and the nucleotide sequence of the amplified gene was analyzed by a standard method. It was found that it contains a sequence of the 5' upstream region from the DNA sequence of the original EST (BF057073). The DNA sequence amplified by PCR is shown in SEQ ID NO: 257.

Subsequently, PCR was carried out by using PCR primers designed based on the sequence of another EST sequence (BU859386) that is thought to be located near BF057073 and the sequence of the gene isolated and identified as described above. Five pmole of each of LS858 (ATGGCTTCGT TCCCCGAGAC CGATTC: SEQ ID NO: 258) and LS859 (GAAGACGAGG ATTCGATTGT TGCCAAAGT CCACC: SEQ ID NO: 259) was used as PCR primers, and PCR was carried out in the same conditions as described above except for performing 35 cycles of a reaction consisting of 95° C. for 30 seconds and 68° C. for 3 minutes. A band of about 2,500 bp was amplified. After the PCR amplification product was inserted into pGEM-T Easy vector in the same manner as described above, the nucleotide sequence was identified. It was found that the product further contains a sequence of further 5' upstream. The DNA sequence amplified by PCR is shown in SEQ ID NO: 260.

Based on the sequence of the two amplified products obtained by the PCR method described above, a novel cDNA consisting of the total length of 3,401 bp was identified, which contains one open reading frame (FIG. 67). Its nucleotide sequence and the amino acid sequence deduced from the nucleotide sequence are shown in SEQ ID NOs: 15 and 72, respectively. A Blast search was conducted based on the sequence isolated and identified in this study. It was found that the gene shows homology to GenBank No. XM_067369 (SEQ ID NO: 263), but contains a region having a partially different sequence (FIG. 68). In this way, a novel gene whose expression is elevated specifically in a liver cancer cell was isolated, identified and named K#1.

Figure 69:
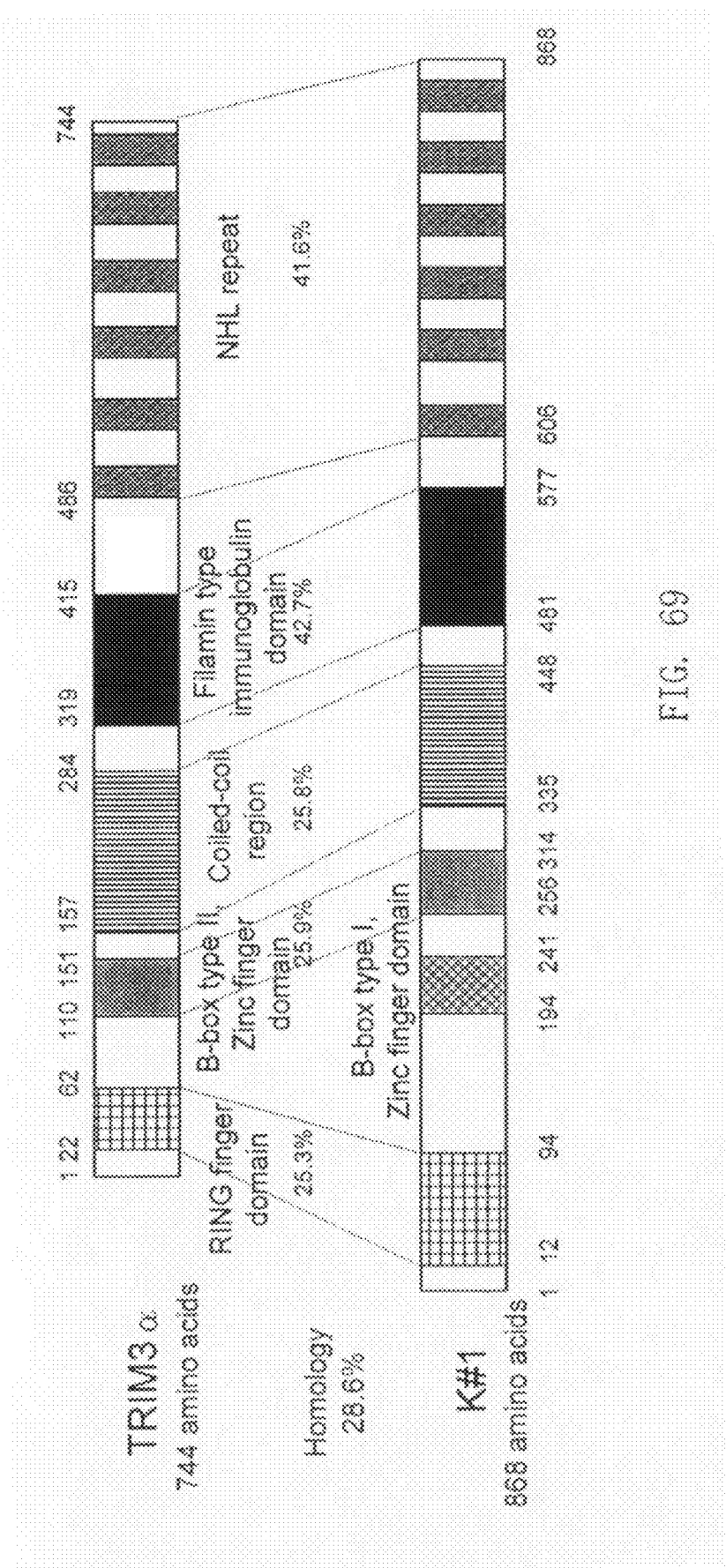
FIG. 69 shows the results of analyzing the amino acid sequence motif of a novel gene K#1.

A homology search was conducted based on the amino acid sequence deduced from the nucleotide sequence isolated in this study against known proteins. The sequence showed a homology of 28.6% to human TRIM3a (tripartite motif-containing 3, GenBank No: NM_006458) and a homology of 27.5% to human TRIM2. It has been reported that there are 37 types of genes belonging to TRIM family, and it is known that they have several characteristic motifs (Reymond A., et al., *EMBO J.* (2001) 20. 2140-2151). Thus, a motif analysis was carried out based on the amino acid sequence of K#1. The novel gene was found to have a motif structure which is relatively similar to that of TRIM3 or TRIM2 as well as the homology of the amino acid sequence. In fact, as shown in FIG. 69, characteristic motifs similar to TRIM3α were found to be conserved. However, since a molecule having exactly the same structure as the motif structure of K#1 does not exist in the known TRIM family, it was strongly suggested that K#1 isolated and identified in this study is a novel TRIM molecule that is relatively similar to TRIM2 and TRIM3. Further, it has been suggested that rat BERP having a structure similar to that of TRIM3 is localized in a cell, binds to myosin V or the like, and is involved in the intracellular transport of protein or is involved in neurite outgrowth as in the case of K#1 (El-Husseini, A. et al., *Biochem. Biophys. Res. Commun.* 267, 906-911, 2000, El-Husseini, A. et al., *J. Biol. Chem.* 274, 19771-19777, 1999). Accordingly, it is believed that the K#1 protein identified in this study belongs to the TRIM family and may be involved in morphogenesis or growth of cells by playing a role in intracellular protein transport in the same manner as rat BERP. It was also suggested that the protein may play an important role in a disease in which its expression is elevated, such as liver cancer, and may serve as a target molecule of a drug.

Example 4

4-1. Isolation and Identification of Full-length cDNA for Gene Expressed in Liver Cancer (TEG23)

cDNA was isolated and identified by RACE (rapid amplification of cDNA ends) method to determine the full-length cDNA sequence of TEG23 whose expression was found to be elevated in liver cancer in the above-mentioned Gene chip analysis and RT-PCR analysis.

More specifically, a 5'-RACE analysis was carried out with a SMART RACE cDNA amplification kit (manufactured by Clontech) to identify the sequence at the 5' side from the probe sequence (229349_at_u133B) used in the Gene chip analysis. First, total RNA was obtained by mixing equal amount of each total RNA prepared from HepG2, HuH6 and Hep3B, human liver cancer cell lines, and a single-stranded cDNA was synthesized according to the method attached to the kit from 1000 ng of the total RNA using a primer LS900 (SEQ ID NO: 262: GGGTTCACTT TGGTCTCTAG TACGG) designed based on the sequence of the human EST (GenBank Accession No. AL039884: SEQ ID NO: 261) used as an origin of the probe sequence. Then, cDNA containing the sequence at the 5' side was amplified by PCR by using the synthesized single-stranded cDNA as a template. More specifically, by using 1.25 µL of the single-stranded cDNA and 5 pmole of LS900 as a PCR primer, PCR reaction was carried out according to the method attached to the kit. The PCR was carried out as follows: denaturation at 94° C. for 1 minute, 35 cycles of 98° C. for 10 seconds and 68° C. for 3 minutes, and incubation at 72° C. for 5 minutes. The PCR product of about 5,000 bp was inserted into pGEM-T Easy vector (manufactured by Promega), *E. coli* DH5α (manufactured by Toyobo) was transformed with the vector by a standard method, and then plasmid DNA was prepared from the obtained transformants. The nucleotide sequence of the gene inserted in the plasmid DNA was analyzed to isolate two clones, clone 11 and clone 18, which have different nucleotide sequence. The nucleotide sequences are shown in SEQ ID NO: 64 and SEQ ID NO: 65, respectively with the sequence of human EST (GenBank Accession No. AL039884) attached to the 3' side. It was found that both of the two types of clones isolated in this study have an open reading frame encoding 250 amino acids (clone 11) or 210 amino acids (clone 18), respectively (FIGS. 70 and 71). The amino acid sequences deduced from clone 11 and clone 18 are shown in SEQ ID NOs: 81 and 82, respectively. When the amino acid sequences deduced from the two types of clones obtained this time were compared, clone 11 is longer than clone 18 by 40 amino acids at the N-terminal side, suggesting that the two types of clones isolated in this study may be splicing variants having different exons used at the 5' side. In this way, a novel gene whose expression is elevated specifically in a liver cancer cell was isolated, identified and named K#2.

A Blast search was carried out based on the amino acid sequence of K#2 (clone 11) to identify homologous proteins. The novel gene was found to have a homology of 71.8% to human LIN-28 (GenBank No. NM_024674) (SEQ ID NO: 264) and a homology of 33.1% to *Caenorhabditis elegans* LIN-28 (GenBank No. NM_059880) (SEQ ID NO: 265). Since LIN-28 homologue is a protein also conserved in a higher organism such as mouse and human, as well as *Caenorhabditis elegans* and *Drosophila* (Moss, E. G. et al., Dev. Biol., 258, 432-442, 2003), the amino acid sequences of *Xenopus laevis* LIN-28 (GenBank No. AF521098) (SEQ ID NO: 266), *Drosophila* LIN-28 (GenBank No. AF521096) (SEQ ID NO: 267), mouse LIN-28 (GenBank No. NM_145833) (SEQ ID NO: 268) as well as human LIN-28 and *Caenorhabditis elegans* LIN-28 were compared. It was found that every sequence contains a cold shock domain and a zinc finger domain (FIG. 72), strongly suggesting that K#2 isolated and identified in this study may possibly be a human LIN-28 homologue. Incidentally, it has been revealed that LIN-28 protein plays a role in regulation of cell fate in the developmental stage by binding to mRNA and participating in the translation from mRNA or the stability of mRNA (Moss, E. G. et al., Cell, 88, 637-646, 1997). Accordingly, it is believed that K#2 protein may have a function similar to that of LIN-28. K#2 is predicted to be involved in the regulation in human developmental stage, the development or growth of cancer cells, the replication of viruses such as hepatitis virus or the like.

4-2. Production of Anti-K#2 Antibody

In order to test whether cancer can be detected by using an anti-K#2 antibody, an anti-K#2 antibody was prepared.

As an antigen for immunization against K#2, a recombinant GST fusion protein was prepared using a partial sequence of the amino acids (1-210 aa) of K#2 (clone 18). More specifically, a gene encoding K#2 (1-210 aa) was amplified by the PCR method using K#2 cDNA clone 18 as a template and using primer F (SEQ ID NO: 278) and primer R (SEQ ID NO: 279), and the amplified gene was inserted into pGEM-Te vector (manufactured by Promega). After the nucleotide sequence was confirmed by a standard method, the vector was digested with restriction enzymes EcoRI and NotI, and the digested gene fragment was inserted into pDEST15 (manufactured by Invitrogen), to construct an expression vector pDEST15-K#2.

SEQ ID NO: 278 (F):
CACCATGGGATTTGGATTCATCTCCATGAT

SEQ ID NO: 279 (R):
TGTCTTTTTCCTTTTTTGAACTGAAGGCCCC

Then, by using the expression vector pDEST15-K#2, a GST-binding antigen protein (k#2 (1-210 aa)) was prepared in the same manner as described above. In order to produce a K#2 polyclonal antibody, a rabbit was immunized with the k#2 (1-210 aa)-GST fusion protein, and the antiserum was prepared. More specifically, in the initial immunization the K#2_GST fusion protein suspended in PBS (100 µg/0.5 mL/rabbit) was mixed with 0.5 mL of Freund's complete adjuvant (DIFCO) to obtain an emulsion and administered to a New Zealand white rabbit (10 weeks of age, female, purchased from Clea Japan) by subcutaneous injection. Thereafter, an emulsion obtained by mixing the K#2_GST fusion protein suspended in PBS (100 µg/0.5 mL/rabbit) with 0.5 mL of Freund's incomplete adjuvant was administered by subcutaneous injection at two weeks intervals for a total of 4 times immunization. Blood was collected before each immunization and after the third and fourth immunization, and an increase in the antibody titer against the K#2_GST fusion protein was measured by ELISA. After an increase in the antibody titer was observed, whole blood was collected, and K#2-immune rabbit antiserum was obtained, which was used as a K#2 polyclonal antibody.

4-3. Detection of K#2 Protein Molecule Using Anti-K#2 Polyclonal Antibody

In order to test the reactivity of the K#2-immune rabbit antiserum prepared as described above, K#2 was measured in cell lysates from a cell line forcibly expressing K#2 and a variety of cancer cell lines.

An animal cell expression vector for expressing K#2 was prepared by inserting the above-mentioned cDNA encoding K#2 into pcDNA3.1 to construct a K#2 gene expression vector pcDNA3.1-K#2. Then, 1 µg of the expression vector pcDNA3.1-K#2 was introduced into $2 \times 10^5$ HEK293 cells by using FuGene 6 reagent (manufactured by Roche Diagnostics) and the cells were made to transiently express K#2. The cells at three days after introduction of the expression vector were collected, and the cultured cells were solubilized in RIPA buffer (150 mM sodium chloride, 1% NP-40, 0.5% deoxycholic acid, 0.1% SDS, 50 mM tris hydroxyaminomethane hydrochloride (pH 8.0)), whereby a cell lysate was prepared. Each lysate in an amount corresponding to 3 mg of protein was loaded on a SDS-polyacrylamide gel and the protein was separated by SDS-PAGE and transferred to Hybond-P (manufactured by Amersham Biosciences). Then, K#2 was detected by ECL plus (manufactured by Amersham Biosciences) using the anti-K#2 polyclonal antibody (1:5,000 dilution of antiserum) as a primary antibody and an HRP-labeled anti-rabbit IgG antibody (manufactured by Jackson) as a secondary antibody. A band was detected, which is considered to be K#2.

Figure 78:
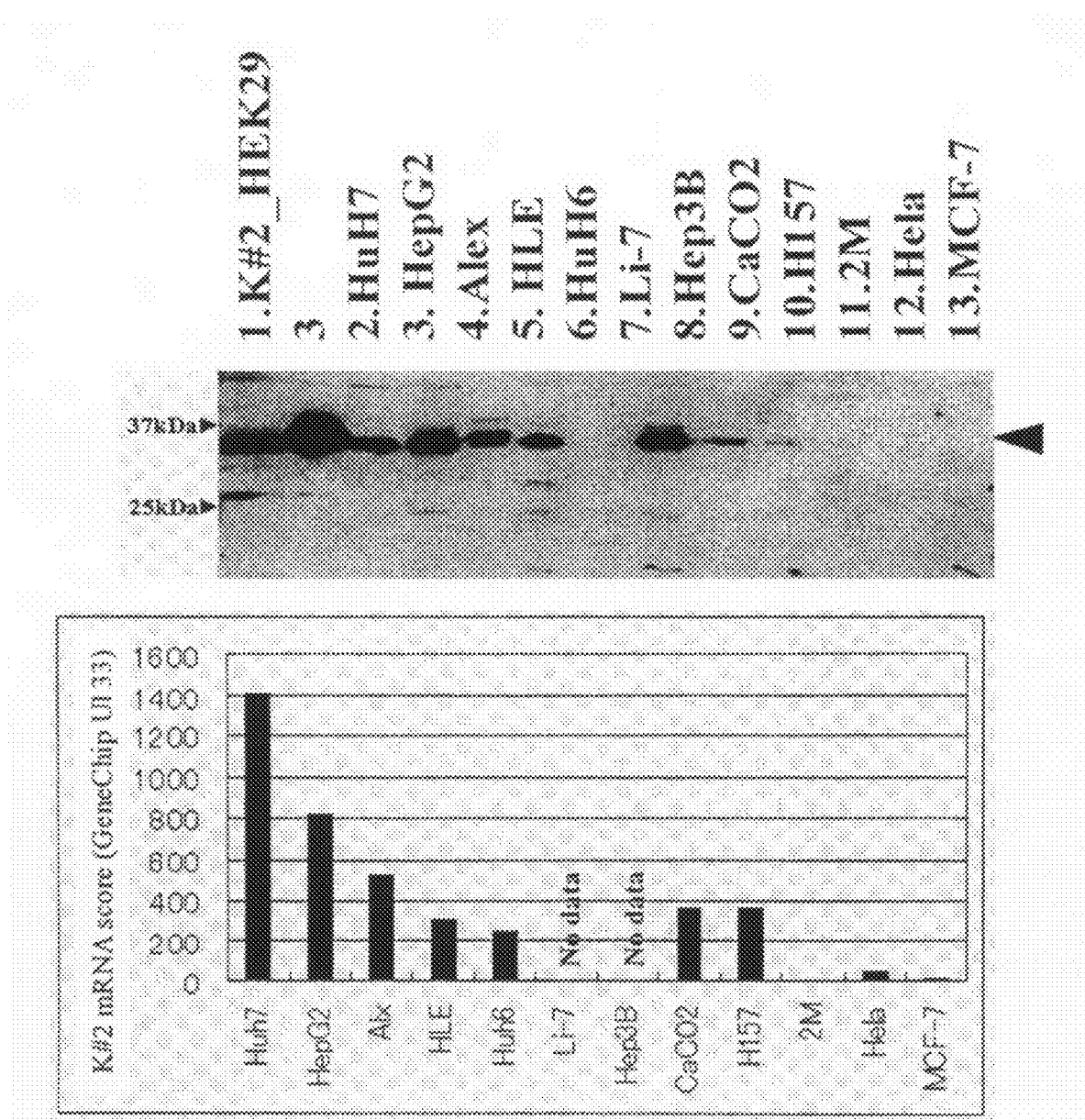
FIG. 78 shows the detection of a K#2 protein molecule in a cell line forcibly expressing K#2 and a variety of cancer cell lines using an anti-K#2 antibody.

In parallel, the cell lysates from a variety of cancer cell lines was analyzed by Western blot analysis in the same way. The result agrees with the analysis results of GeneChip U133, and a band with a molecular weight of about 27 kDa, which is considered to be the full-length K#2, was successfully detected only in a cell line which showed a high mRNA expression score (FIG. 78). No GeneChip data was available for Li-7 cell and Hep3B cell.

4-4. Expression Analysis of K#2 Protein in Liver Cancer Tissue Using Anti-K#2 Polyclonal Antibody Extract from K#2 cancer tissue was analyzed by Western blot analysis using the anti-K#2 polyclonal antibody. Human tissue extract was prepared by adding RIPA-buffer (150 mM sodium chloride, 1% NP-40, 0.5% deoxycholic acid, 0.1% SDS, 50 mM tris hydroxyaminomethane hydrochloride (pH 8.0)) to tissue sections, followed by homogenization by sonication, and then collecting the supernatant fraction by centrifugation. The protein concentration was determined by the Bradford method for each extract sample, and the sample was adjusted at a concentration of 4 mg/mL. Then, the sample was mixed with an equal amount of SDS-sample buffer and heated at 95° C. for 5 minutes. Ten mg of each of the extract samples was applied to 15% polyacrylamide gel and subjected to SDS-PAGE.

Figure 79:
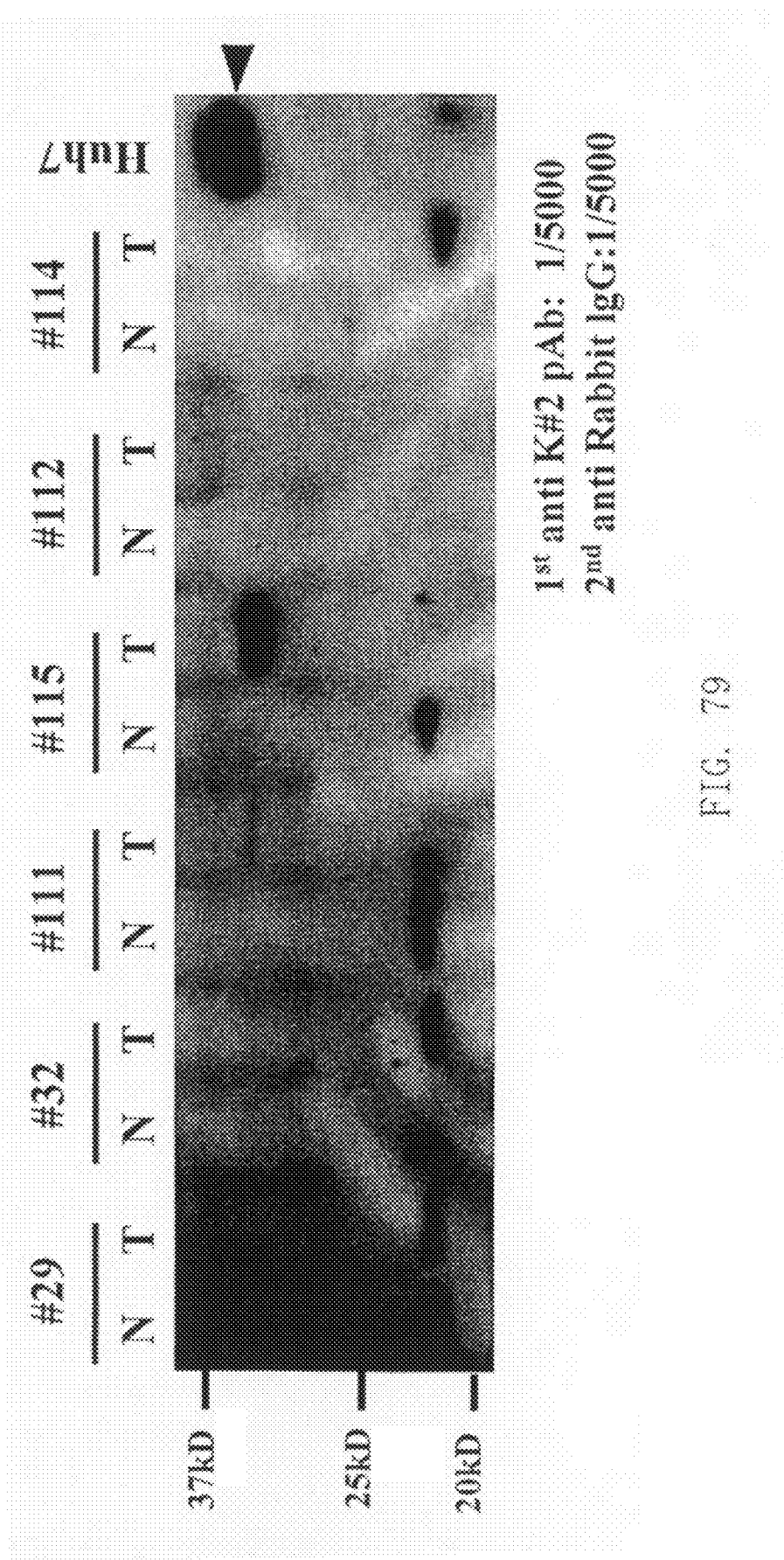
FIG. 79 shows the results of an expression analysis of K#2 protein in liver cancer tissue using an anti-K#2 antibody.

The sample was analyzed by Western blot analysis using the anti-K#2 polyclonal antibody in the same manner as described above. A specific band near K#2 was specifically detected in the extract from the cancerous part (FIG. 79).

From the above results, it was found that the TEG23: K#2 molecule is highly expressed specifically in the cancerous part even at the protein level and secreted in a cancer cell line, suggesting that the molecule is useful for diagnosis of cancer with an anti-K#2 antibody using tissue and serum specimens.

Example 5

Production of Anti-TEG1: C20orf102 Monoclonal Antibody

In order to determine whether cancer can be detected using an anti-C20orf102 antibody, an anti-C20orf102 monoclonal antibody was prepared.

5-1. Isolation of C20 orf102 cDNA

In order to express C20orf102, C20orf102 cDNA was first isolated as follows. A single-stranded cDNA was prepared from lung adenocarcinoma tissue according to the above-mentioned method. Then, PCR was carried out using the single-stranded cDNA as a template and primers F (SEQ ID NO: 269) and R (SEQ ID NO: 270) with a restriction enzyme site for EcoRI or XhoI. A band near about 615 bp was successfully detected, which agrees with that of the predicted sequence of C20orf102. Advantage HF Polymerase Mix (manufactured by Clontech), Advantage HF PCR buffer, 200 µM deoxynucleotide triphosphate and 0.2 µM primer were used as the enzymes and reagents for PCR, and PCR (35 cycles of 94° C. for 30 seconds, 68° C. for 30 seconds and 72° C. for 3 minutes) was carried out using 1 µL of the cDNA as a template. The specifically amplified fragment obtained by PCR was inserted into pGEM-T Easy vector (manufactured by Promega) using a DNA ligation kit (manufactured by Takara). The nucleotide sequence was checked by a standard method, and the isolated cDNA was found to correspond to C20orf102. The primers F and R were designed to hybridize with the 5' end and 3' end of C20orf102 gene (GenBank: NM_080607), respectively.

SEQ ID NO: 269 (F): CGAATTCATGGGGGCCCCGCTCGCCGTAGC

SEQ ID NO: 270 (R): CCTCGAGGAGGCTGCAGGCCTCCTGGTCCA

5-2. Preparation of Antigen for Immunization Against C20orf102

The pGEM-T Easy vector incorporated with the PCR product was transformed into a competent cell XL-1 Blue (manufactured by Stratagene), and the vector bearing the PCR product was selected by color selection using 5-bromo-4-chloro-3-indolyl-β-galactopyranoside (X-gal). As for the transformation, 10 μL of a ligation reaction product was added to the competent cells, the mixture was cooled on ice for 30 minutes, and the cells were subjected to heat shock at 42° C. for 45 seconds and cooled on ice for 2 minutes thereby inducing transformation. Further, in order to allow an antibiotic resistance gene to be expressed, 900 μL of LB medium without antibiotics was added and the mixture was mildly stirred at 37° C. for 30 minutes. Then, the cells were collected by centrifugation and plated on an LB plate containing ampicillin to which 20 μL of 20 mg/mL X-gal had been sprayed, and the cultivation was carried out at 37° C. for 16 hours. Among the colonies grown on the plate, 5 colonies without developing color (i.e. the PCR product is expected to be incorporated into the vector) were selected, and the cells were grown in 5 mL of LB medium containing ampicillin at a final concentration of 100 μg/mL at 37° C. for 16 hours with vigorous stirring. Plasmid DNA was collected by phenol/chloroform extraction from a portion of the grown cells, then 0.5 μL of EcoRI (8 U/μL), 2 μL of a 10×H buffer and 7.5 μL of distilled water were added thereto, and the plasmid was digested at 37° C. for 1 hour. The size of the digested fragment was confirmed to be the same as that of the PCR product by electrophoresis on a 0.8% agarose gel. The plasmid DNA into which C20orf102 gene is considered to have been inserted was collected using a Quantum Prep Plasmid Miniprep Kit (manufactured by BioRad). The plasmid was eluted with distilled water. After the nucleotide sequence was determined by a standard method, DNA was digested with restriction enzymes EcoRI and XhoI. Then the digested fragment was inserted into an *E. coli* protein expression vector, pET41a vector (manufactured by Novagen). The gene incorporated into pET41 is translated as a GST fusion protein.

pET41 was digested with restriction enzymes (EcoRI and XhoI), subjected to electrophoresis and purified by using a Qiaquick Gel Extraction Kit. A fragment having the sequence of C20orf102 was amplified by pGEM-T Easy and was inserted into pET41 using a DNA ligation kit.

To 4 μL of the C20orf102 fragment purified from pGEM-T Easy, 5 μL of a ligation buffer and 1 μL of pET41 were added and the mixture was incubated at 16° C. for 30 minutes.

After finishing the ligation reaction, the plasmid DNA was transformed into XL-1 Blue, the cells were grown with shaking in LB medium containing kanamycin for 16 hours. From the grown *E. coli* cells, the plasmid was purified using a Quantum Prep Plasmid Miniprep Kit. In order to confirm the insertion of C20orf102 into pET41, the plasmid was sequenced with a primer pair (SEQ ID NOs: 271 and 272) corresponding to the sequence of pET.

SEQ ID NO: 271: TTCGAACGCCAGCACATGGAC

SEQ ID NO: 272: GCTAGTTATTGCTCAGCGGTG

The pET41 vector bearing C20orf102 was transformed into a competent cell of BL21 Codon PLUS RIL (manufactured by Novagen) having T7 promoter.

Transformation was carried out according to the following procedure. To 100 μL of BL21 Codon PLUS RIL, 1 μL of pET-C20orf102-FL was added at a concentration of 1 μg/μL and the mixture was cooled on ice for 5 minutes. Then, the mixture was placed in a thermostat bath at 42° C. for 20 seconds, and the cells were subjected to heat shock. Then, the mixture was cooled on ice for 2 minutes, and 900 μL of LB without antibiotics was added. Then, the cells were incubated at 37° C. for 10 minutes, and centrifuged (100×g, 5 min). After the supernatant was discarded, the competent cells were resuspended and plated on an LB plate containing kanamycin, and then selection culture was carried out at 37° C. for 16 hours.

The GST fusion protein of C20orf102 expressed in *E. coli* was purified by affinity purification utilizing the binding of GST to glutathione. First, the culture solution was centrifuged at 6000×g for 10 minutes at 4° C. to collect *E. coli* cells. A cell lysis buffer (50 mM sodium chloride, 1 mM EDTA, 1 mM dithiothreitol (DTT), 50 mM tris hydroxyaminomethane hydrochloride, pH 8.0) was added and the mixture was sonicated on ice. Triton X-100 was added at a final concentration of 1%, and centrifuged at 13400×g for 45 minutes at 4° C. to collect the supernatant. To the supernatant, 500 μL of glutathione sepharose (manufactured by Amersham Biosciences) was added, and end-over-end mixing was carried out at 4° C. for 1 hour to allow the GST-C20orf102 fusion protein to be adsorbed.

Glutathione sepharose was collected by centrifugation (3000×g, 4° C., 5 min) and washed with 10 mL of PBS-T (PBS containing 0.5% Triton X-100). An elution buffer (50 mM reduced glutathione, 200 mM sodium chloride, 1 mM EDTA, 1 mM DTT, 200 mM Tris-HCl, pH 8.0) was added and mixed end-over-end at 4° C. for 1 hour to elute the GST fusion protein. The glutathione sepharose was removed by centrifugation (3000×g, 4° C., 5 min) to obtain a purified protein of GST-fused C20orf102. A PBS solution of the fusion protein was prepared using a PD-10 column (manufactured by Amersham Biosciences), and the protein concentration was determined by the Bradford method. The purity of the protein was assayed by SDS-PAGE to confirm that the obtained protein satisfies the amount and purity required for immunization. The protein was used as an immunogen to produce a monoclonal antibody as described below.

5-3. Production of C20orf102 Monoclonal Antibody

A purified product (*E. coli-expressed* protein) of the GST fusion protein of the full-length human C20orf102 was used as an immunogen. Mice (BALB/c female at 6 weeks of age) were immunized three times with the immunogen at 50 μg/mouse, and the antibody titer in the serum was assayed. The antibody titer assay was carried out by an immunogen solid-phase ELISA method. A dilution series of the immunized mouse serum pretreated with GST protein to absorb the anti-GST antibody was reacted with the immunogen immobilized on an ELISA plate in an amount of 0.5 μg/well. It was reacted with an HRP-labeled anti-mouse antibody, and then the absorbance at 450 nm was measured for the developed color upon addition of a substrate.

Mice showing an increase in the antibody titer received a final immunization with the antigen at 25 μg/mouse. Spleen cells were collected at 72 hours after the final immunization, and fused with myeloma cells (P3/NSI-1-Ag4-1) (Kohler, G, Milstein, C: Nature, 256: 495 (1975)). The cells were cultured in HAT selection medium to obtain hybridomas. The culture supernatant of the hybridomas was pre-absorbed with GST protein and assayed by an immunogen solid-phase ELISA to primarily select those reacting with C20orf102 (actual product). The immunogen ELISA positive hybridoma was assayed for the specificity of the antibody by Western blotting using a protein extract solution from COS7 cells forcibly expressing C20orf102. A positive hybridoma was cloned by a limiting dilution method, whereby a monoclonal antibody-producing cell line was established. The antibody-producing hybridoma was inoculated into BALB/c mice, and mouse ascites was obtained. The monoclonal antibody in the ascites was purified by an ammonium sulfate precipitation method to obtain a purified antibody preparation. In this way, an anti-C20orf102 antibody H9615 was prepared.

Example 6

Detection of C20orf102 Protein Molecule Using Anti-C20orf102 Monoclonal Antibody In order to test the reactivity of the anti-C20orf102 monoclonal antibody H9615 prepared as described above, C20orf102 protein was measured in cell lysates of a cell line forcibly expressing C20orf102 and cell lysates of a variety of cancer cell lines.

First, the reactivity of the anti-C20orf102 monoclonal antibody H9615 was examined by Western blot analysis using a COS7 cell line forcibly expressing C20orf102. A C20orf102 gene expression vector was constructed by inserting the C20orf102-encoding cDNA into pcDNA4Mys-His (manufactured by Invitrogen) and used as an animal cell expression vector. More specifically, 1 µg of the expression vector was introduced into $5 \times 10^4$ COS7 cells using FuGene 6 reagent (manufactured by Roche Diagnostics) and the cells were made to transiently express C20orf102. Three days after introduction of the expression vector, the cells were collected and were solubilized with RIPA buffer (150 mM sodium chloride, 1% NP-40, 0.5% deoxycholic acid, 0.1% SDS, 50 mM tris hydroxyaminomethane hydrochloride (pH 8.0)) to prepare a cell lysate. Each lysate in an amount corresponding to 10 µg of proteins was loaded on a SDS-polyacrylamide gel and the protein was separated by SDS-PAGE and transferred to Hybond-P (manufactured by Amersham Biosciences). The protein was detected by ECL plus (manufactured by Amersham Biosciences) using the anti-C20orf102 monoclonal antibody H9615 (1 µg/mL) and HRP-labeled anti-mouse IgG antibody (manufactured by Jackson) as a secondary antibody. A specific band was detected near the theoretical molecular weight of 22.5 kDa, which is considered to be the C20orf102 protein.

Figure 74:
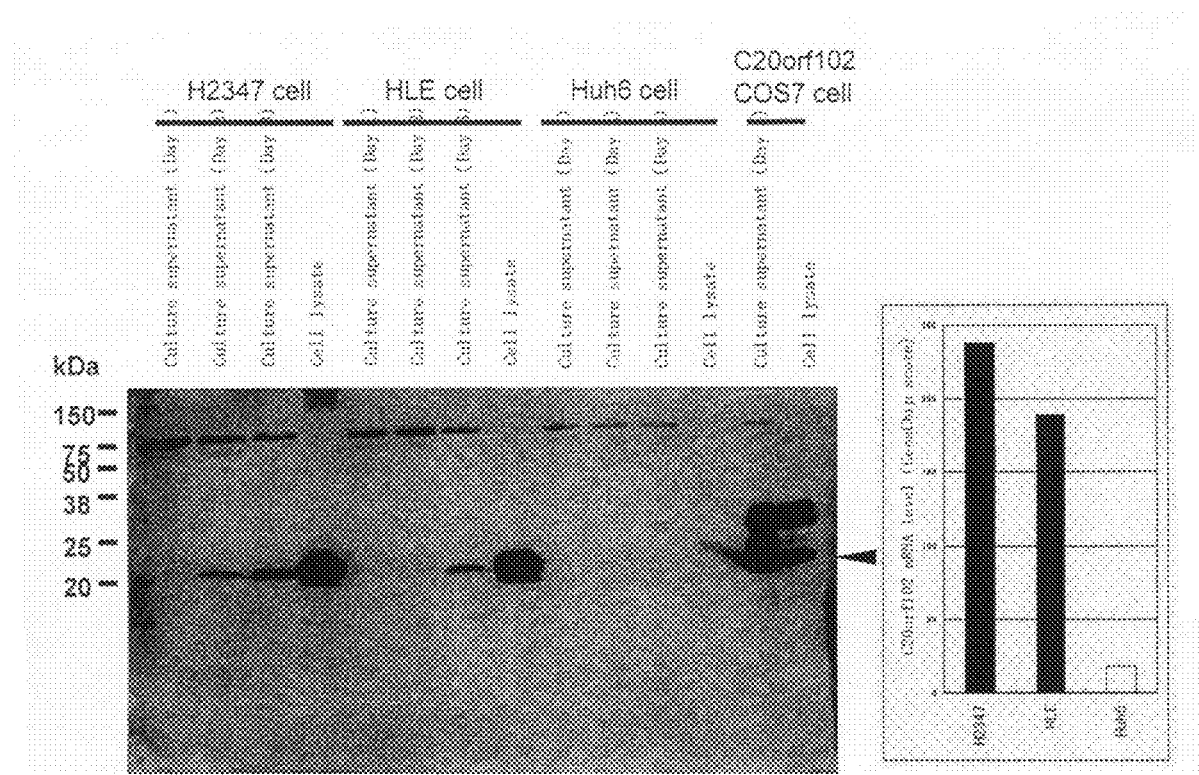
FIG. 74 shows the detection of a C20orf102 protein molecule in a variety of cancer cell lines and a culture supernatant thereof using an anti-C20orf102 antibody.

In parallel, the cell lysates from a variety of cancer cell lines were assayed by Western blot analysis in the same way as above. The result was consistent with the analysis results from GeneChip U133, namely, a band which is considered to be the full-length C20orf102 with a molecular weight of about 22.5 kDa was successfully detected only in the cell lines which showed a high mRNA expression score (FIG. 74).

Further, since C20orf102 gene has a secretory signal in the predicted sequence, it was examined whether a secretory form of C20orf102 can be detected in the culture supernatant of a cancer cell line expressing C20orf102. A band with the same molecular weight as that in the culture supernatant of the cell line forcibly expressing C20orf102 was also detected in the culture supernatant of the cancer cell lines overexpressing C20orf102 by the anti-C20orf102 monoclonal antibody (FIG. 74).

From the above results, it was found that the anti-C20orf102 monoclonal antibody H9615 can specifically detect C20orf102 and that the mRNA expression level from the GeneChip analysis agrees with the C20orf102 protein expression level. Further, from the study using the anti-C20orf102 monoclonal antibody, it was found that secretory C20orf102 is present in the culture supernatant of C20orf102-expressing cells, strongly suggesting that the presence or absence of cancer cells may possibly be determined by detecting the secretory form of C20orf102.

Example 7

Figure 75:
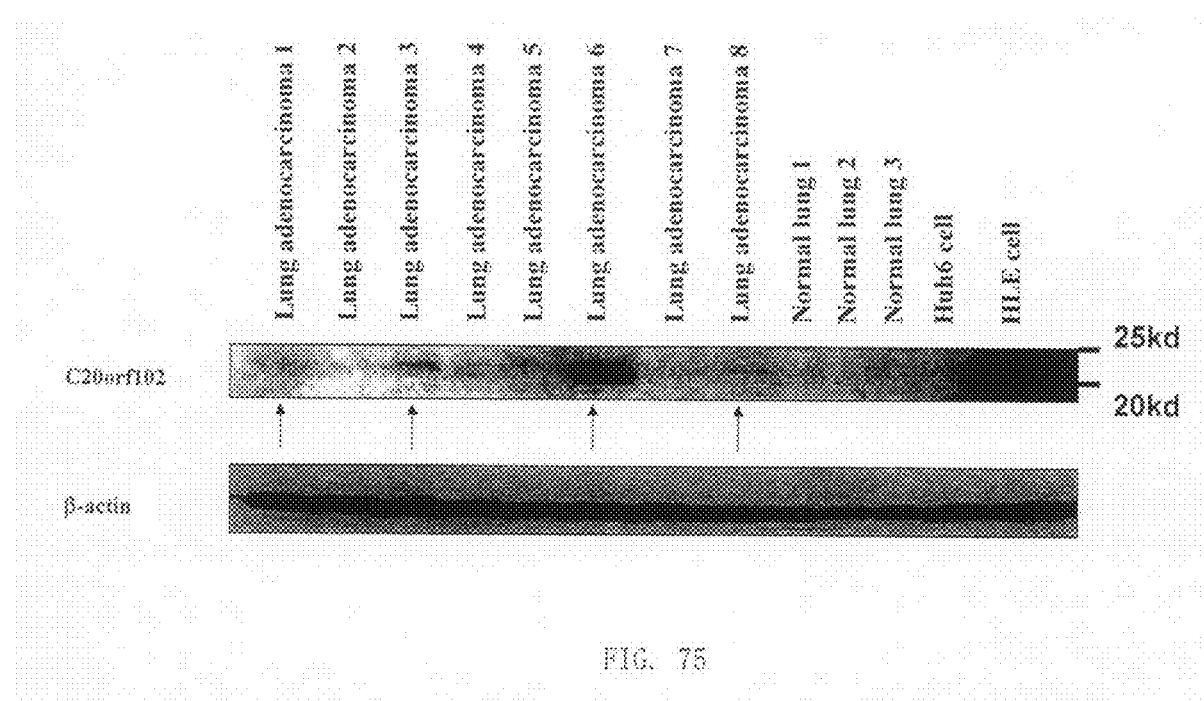
FIG. 75 shows the results of an expression analysis of C20orf102 protein in lung adenocarcinoma tissue using an anti-C20orf102 antibody.

Expression Analysis of C20orf102 Protein in Lung Adenocarcinoma Tissue Using Anti-C20orf102 Monoclonal Antibody Tissue extract from lung adenocarcinoma was analyzed by Western blot analysis using the anti-C20orf102 monoclonal antibody H9615. Human tissue extract was prepared by adding RIPA buffer (150 mM sodium chloride, 1% NP-40, 0.5% deoxycholic acid, 0.1% SDS, 50 mM tris hydroxyaminomethane hydrochloride (pH 8.0)) to tissue fragments, followed by homogenization by sonication, and then collecting the supernatant fraction by centrifugation. The protein concentration was determined by the Bradford method for each extract sample, and the sample was adjusted at a concentration of 4 mg/mL. Then, the sample was mixed with an equal amount of SDS-sample buffer and heated at 95° C. for 5 minutes. Ten µg of each of the extract samples was applied to a 15% polyacrylamide gel and subjected to SDS-PAGE. The sample was analyzed by Western blot analysis with the anti-C20orf102 monoclonal antibody H9615 in the same manner as described above. A specific band near about 22.5 kDa was detected specifically in the cancerous part (FIG. 75).

From the above results, it was found that the TEG1: C20orf102 molecule is highly expressed specifically in the cancerous part even at the protein level and is secreted in a cancer cell line, suggesting that the molecule is useful for diagnosis of cancer by a monoclonal antibody using tissue and serum specimens.

Example 8

Production of Anti-OK/SW-CL . . . 30 Antibody

As for TEG6: OK/SW-CL . . . 30, in order to determine whether cancer can be detected by using an anti-OK/SW-CL . . . 30 antibody, an anti-OK/SW-CL . . . 30 antibody was prepared.

8-1. Isolation of hNotum cDNA

From a public database (UCSC and GenBank) search, it was found that the cDNA sequence of OK/SW-CL . . . 30 is a partial sequence, and in fact, a putative protein LOC147111 (GenBank: NM__178493, SEQ ID NOs: 273 and 274) containing the entire sequence of OK/SW-CL . . . 30 and further contains the 5' region may represent a full-length ORF gene. The sequence contains a signal sequence and has a homology of 42.7% to fly Notum (NM__168642), therefore, it is named hNotum as a novel gene and further analyzed. First, hNotum cDNA was isolated as follows. A single-stranded cDNA was prepared from a HepG2 cell according to the above-mentioned method. Then, PCR was carried out using the prepared single-stranded cDNA as a template and primers WT164 (SEQ ID NO: 275) and LS746 (SEQ ID NO: 276). A band near about 1.5 kbp was successfully detected, which agrees with the predicted sequence of hNotum. In the PCR method, DMSO was added to a reaction mixture prepared according to the protocol of a KOD plus kit (manufactured by TOYOBO) in an amount corresponding to 5% of the total amount of the reaction mixture. The reaction consisted of an initial denaturation at 95° C. for 2 minutes and 35 cycles of 94° C. for 15 seconds and 68° C. for 90 seconds. The specifically amplified fragment obtained by PCR was inserted into pENTR (manufactured by Invitrogen) by the TOPO cloning method, and the nucleotide sequence was checked by a standard method. The isolated cDNA was confirmed to be hNotum.

The primers WT164 and LS746 were designed to hybridize with the 5' end and 3' end of hNotum gene (GenBank: NM_178493), respectively.

```
SEQ ID NO: 275 (WT164):
CACCGAATTCATGGGCCGAGGGGTGCGCGTG

SEQ ID NO: 276 (LS746):
CTCGAGGCTTCCGTTGCTCAGCATCCCCAG
```

8-2. Preparation of Antigen for Immunization Against hNotum

To use as an antigen for immunization against hNotum, a recombinant protein was prepared as a GST-binding protein using a partial sequence of the amino acids. (143 aa to 496 aa) of hNotum. More specifically, a gene encoding hNotum (from 143 aa to 496 aa) was amplified by PCR using the above-mentioned hNotum cDNA as a template and primers LS695 (SEQ ID NO: 277) and LS746 (SEQ ID NO: 276), and the amplified gene was inserted into pGEM-T Easy vector (manufactured by Promega). After the nucleotide sequence was checked by a standard method, the vector was digested with restriction enzymes EcoRI and XhoI, and the digested fragment was inserted into pET41a vector (manufactured by Novagen) to construct an expression vector.

```
SEQ ID NO: 277 (LS695):
GAATTCATGCGGCGCCTCATGAGCTCCCGGGA
```

A GST fusion antigen protein (containing hNotum from 143 aa to 496 aa) was prepared and used for immunizing mice to produce a monoclonal antibody in the same manner as described above, whereby an hNotum monoclonal antibody H9541 was prepared.

Example 9

Detection of hNotum Protein Molecule Using Anti-hNotum Antibody

In order to test reactivity of the produced monoclonal antibody, hNotum was measured in cell lysates from a cell line forcibly expressing hNotum and a variety of cancer cell lines. A vector obtained by inserting the antigen region (from 143 aa to 496 aa) used in the above into pcDNA4 was used as a control. The expected molecular weight is 39.9 kDa. Western blot analysis was carried out in the same manner as above, except that the primary antibody H9541 was used at a final concentration of 100 µg/mL.

Figure 76:
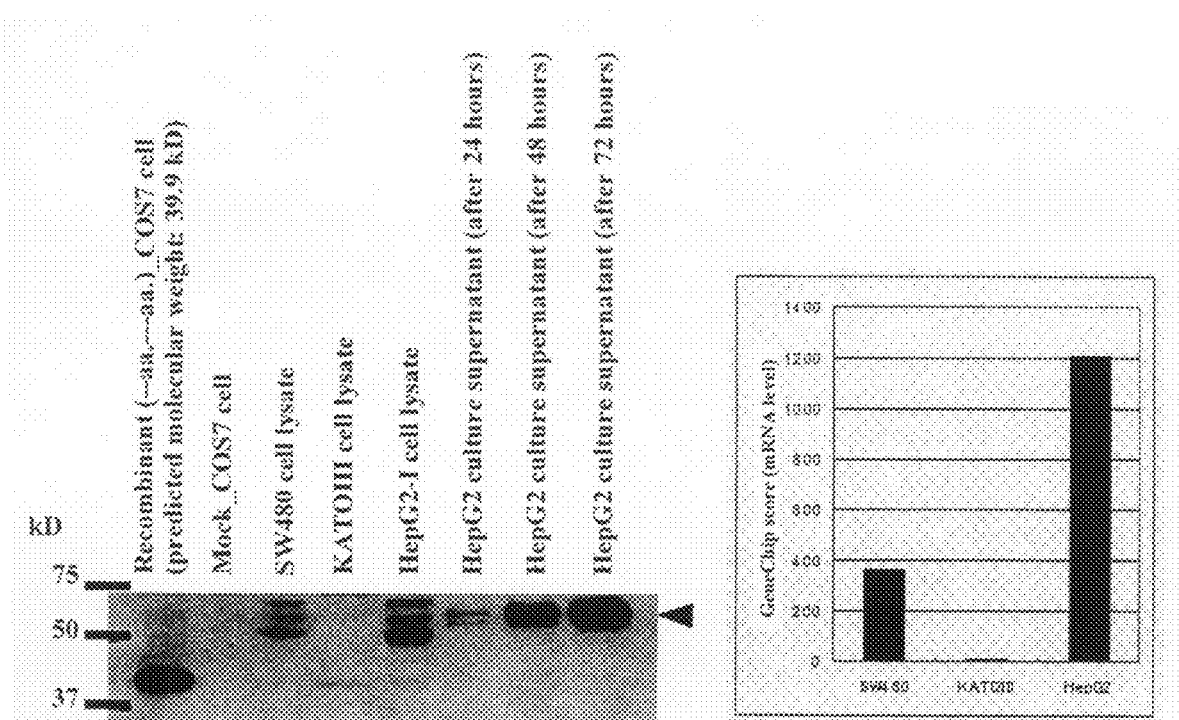
FIG. 76 shows the detection of an hNotum protein molecule in a variety of cancer cell lines and a culture supernatant thereof using an anti-hNotum antibody.

As shown in FIG. 76, a specific band was detected near the position of the 37 kDa marker, which is considered to be hNotum (from 143 aa to 496 aa).

The cell lysates from a variety of cancer cell lines were analyzed by Western blot analysis in the same manner. The result was consistent with the analysis results from GeneChip U133, namely, a band which is considered to be the full-length hNotum with a molecular weight of about 55 kDa was successfully detected only in the cell line which showed a high mRNA expression score (FIG. 76).

Further, since hNotum gene has a secretory signal in the predicted sequence, it was examined whether a secretory form of hNotum can be detected in the culture supernatant of the cancer cell line expressing hNotum. A band with the same molecular weight as that in the culture supernatant of the cell line forcibly expressing hNotum was also detected by the anti-hNotum antibody in the culture supernatant of the cancer cell lines overexpressing hNotum (FIG. 76).

From the above results, it was found that the hNotum monoclonal antibody H9541 can specifically detect hNotum and that the mRNA expression level from GeneChip analysis agrees with the hNotum protein expression level. Further, from the study using the anti-hNotum antibody, it was found that secretory form of hNotum is present in the culture supernatant of hNotum-expressing cells, strongly suggesting that the presence or absence of cancer cells can be determined by detecting secretory form of hNotum.

Example 10

Figure 77:
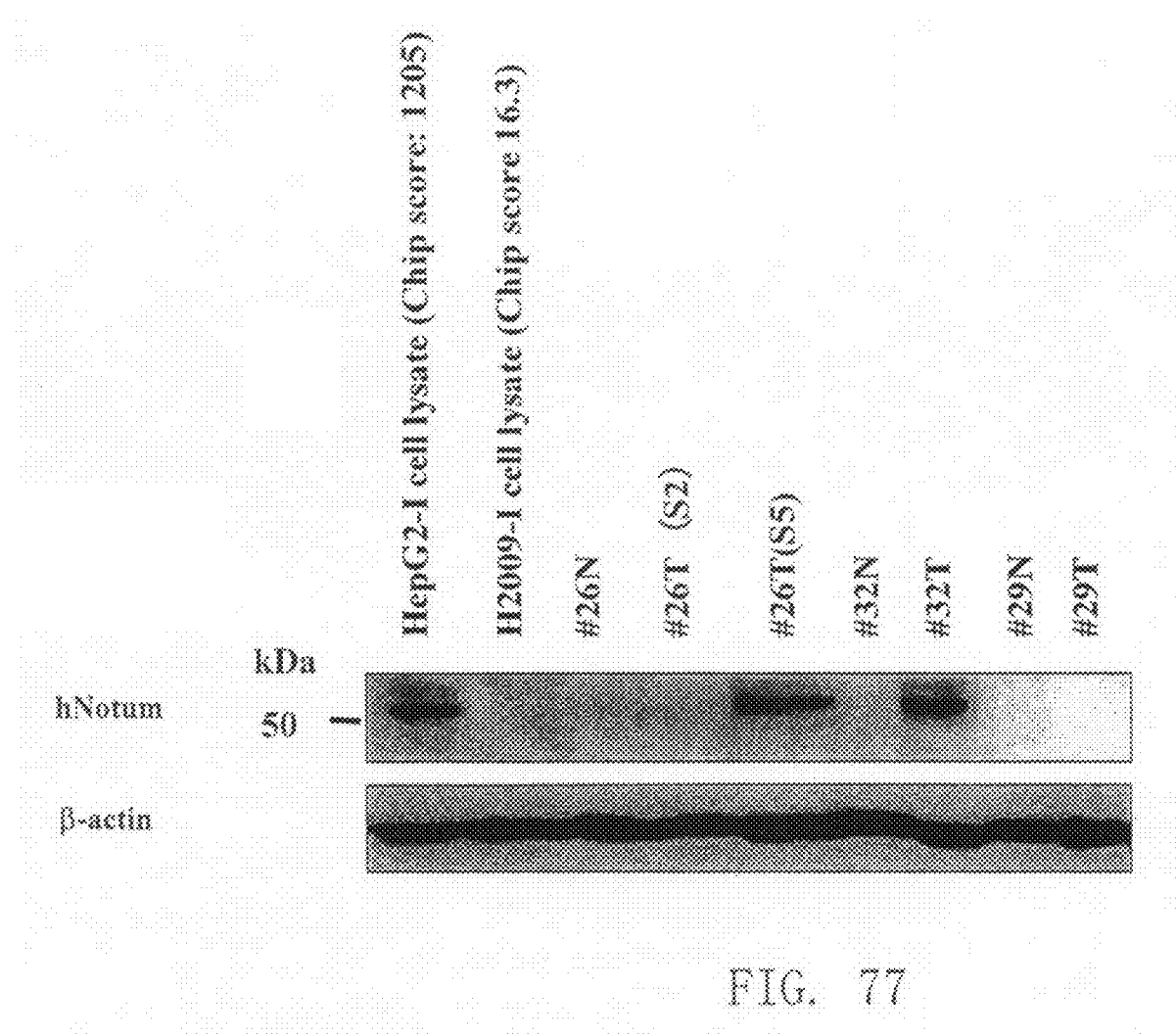
FIG. 77 shows the results of an expression analysis of hNotum protein in lung cancer tissue using an anti-hNotum antibody.

Expression Analysis of hNotum Protein in Liver Cancer Tissue Using hNotum Antibody Tissue extract from liver cancer was analyzed by Western blot analysis using the anti-hNotum antibody. The Western blot analysis was carried out with the hNotum antibody in the same manner as described above. A specific band near hNotum was detected specifically in the cancerous part (FIG. 77). Two samples were positive out of three samples tested. In addition, in Sample #26 containing hepatocellular carcinoma tissues obtained from two sites (S2 and S5) of the same patient, one tissue was positive for hNotum.

From the above results, it was found that the TEG6: hNotum (OK/SW-CL . . . 30) molecule is highly expressed specifically in the cancerous part even at the protein level and is secreted in a cancer cell line, suggesting that the molecule is useful in diagnosis of cancer with a monoclonal antibody using tissue and serum specimens.

Example 11

11-1. Production of Anti-KIAA1359 Antibody

As for TEG37: KIAA1359, in order to determine whether cancer can be detected by using an anti-KIAA1359 antibody, an anti-KIAA1359 antibody was prepared. More specifically, a peptide was synthesized by a standard method with a partial sequence of the amino acids (from 76 aa to 88 aa) of KIAA1359 to be used an antigen for immunization against KIAA1359. C: cysteine residue was added at the N-terminus of the peptide and the peptide was conjugated to Keyhole limpet hemocyanin (KLH), which was used as an immunogen. A monoclonal antibody was produced in the same manner as described above and a monoclonal antibody A8409A was successfully isolated.

```
Peptide sequence: PEAETRGAKRISPA (SEQ ID NO: 280)
```

11-2. Isolation of KIAA1359 cDNA

In order to express KIAA1359, KIAA1359 cDNA was first isolated as follows. A single-stranded cDNA was prepared from MKN74 cell expressing KIAA1359 according to the above-mentioned method. Then, PCR was carried out using the prepared single-stranded cDNA as a template and primers F (SEQ ID NO: 281) and R (SEQ ID NO: 282). A band near about 1.6 kbp was successfully detected, which agrees with that of the predicted sequence of KIAA1359. In the PCR method, a reaction mixture was prepared according to the protocol of an Advantage HF2 kit (manufactured by Clontech). The reaction was carried out under the following conditions: an initial denaturation at 95° C. for 1 minute and 35 cycles of 94° C. for 15 seconds, 63° C. for 30 seconds and 68° C. for 2 minutes, and a final extension reaction at 68° C. for 6 minutes. The specifically amplified fragment obtained by PCR was inserted into pGEM-T Easy (manufactured by Promega) by the TA cloning method, and the nucleotide sequence was checked by a standard method. The isolated cDNA was confirmed to be KIAA1359. Then the cDNA was inserted into pcDNA4/myc-His A (manufactured by Invitrogen), which was used as a KIAA1359 gene expression vector. The primers F and R were designed to hybridize with the 5' end and 3' end of KIAA1359 gene (GenBank: NM_152673), respectively.

```
SEQ ID NO: 281 (F):
GGATCCATGGGCTGTCTCTGGGGTCTGGCTCTGC

SEQ ID NO: 282 (R):
CTCGAGGCCTCTCCTGACACGCAGTAAGGAGACC
```

11-3. Detection of KIAA1359 Protein Molecule Using Anti-KIAA1359 Antibody A8409A In order to test the reactivity of the anti-KIAA1359 antibody A8409A prepared as above, KIAA1359 was detected in cell lysates from a cell line forcibly expressing KIAA1359 and a variety of cancer cell lines.

Figure 80:
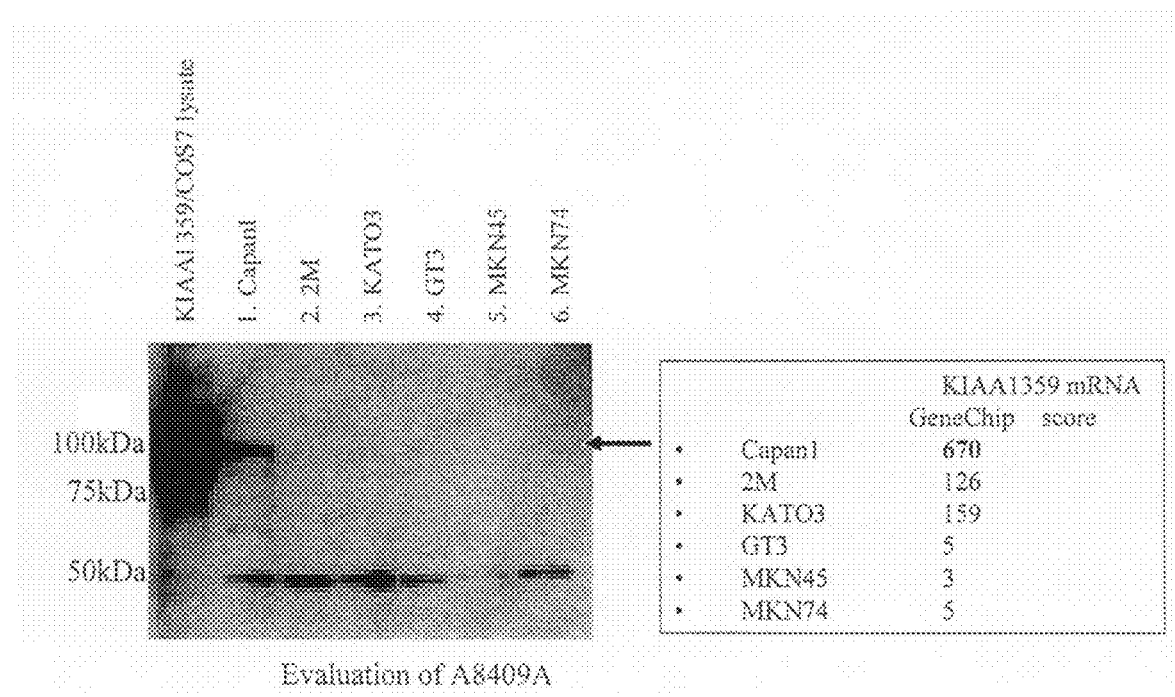
FIG. 80 shows the detection of a KIAA1359 protein molecule in a cell line forcibly expressing KIAA1359 and a variety of cancer cell lines using an anti-KIAA1359 antibody.

Cell lysates of a variety of cancer cell lines were analyzed by Western blot analysis in the same manner using a lysate of COS7 forcibly expressing KIAA1359 as a control. The A8409A antibody was used at a concentration of 100 μg/mL, a band at about 100 kDa was successfully detected in Capan1 which showed a high score of the GeneChip U133 analysis (FIG. 80). This band is the same as that of KIAA1359 forcibly expressed in the control and is considered to be a KIAA1359 molecule.

11-4. Expression Analysis of KIAA1359 Protein in Stomach Cancer Tissue Using Anti-KIAA1359 Antibody A8409A Tissue extract from stomach cancer was analyzed by Western blot analysis with the anti-KIAA1359 antibody A8409A. Human tissue extract was prepared by adding RIPA buffer (150 mM sodium chloride, 1% NP-40, 0.5% deoxycholic acid, 0.1% SDS, 50 mM tris hydroxyaminomethane hydrochloride (pH 8.0)) to tissue fragments, followed by homogenization by sonication, and then collecting the supernatant fraction by centrifugation. The protein concentration was determined by the Bradford method for each extract sample, and the sample was adjusted at a concentration of 4 mg/mL. Then, the sample was mixed with an equal amount of SDS-sample buffer and heated at 95° C. for 5 minutes. Ten 10 mg of each of the extract samples was applied on a 10% polyacrylamide gel and subjected to SDS-PAGE.

Figure 81:
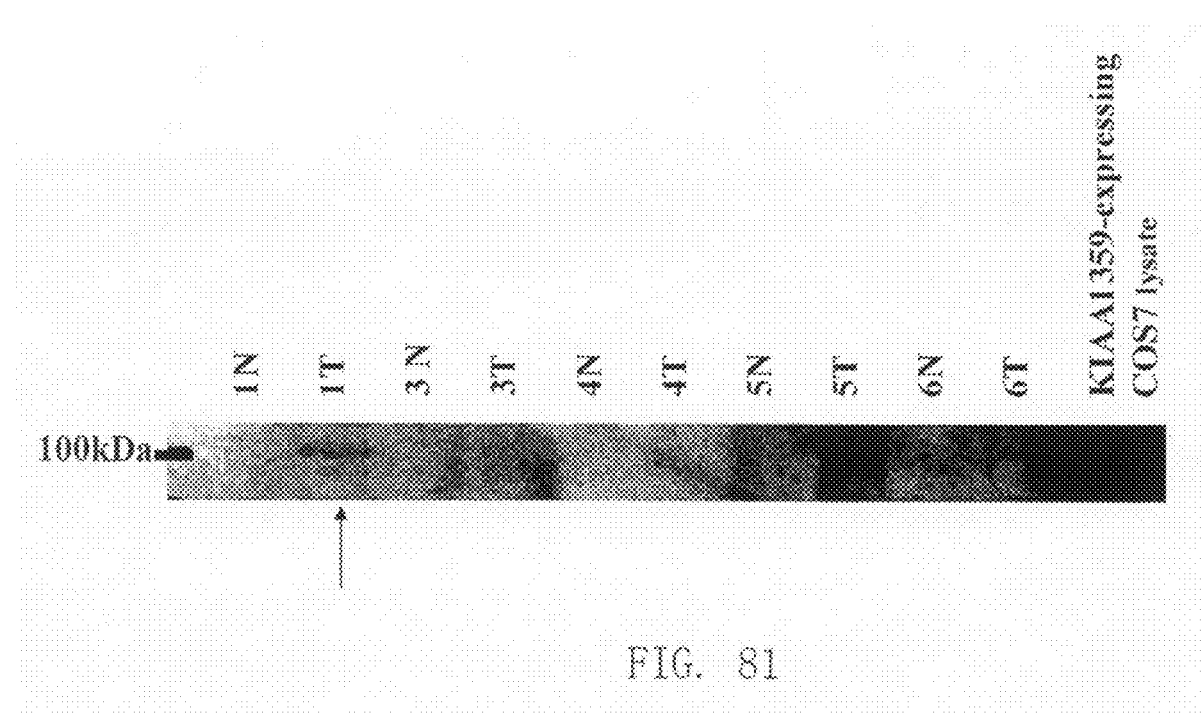
FIG. 81 shows the results of an expression analysis of KIAA1359 protein in stomach cancer tissue using an anti-KIAA1359 antibody.

The sample was analyzed by Western blot analysis with the anti-KIAA1359 antibody A8409A in the same manner as described above. A specific band near 100 kDa was detected specifically in the cancerous part (FIG. 81).

From the above results, it was found that the TEG37: KIAA1359 molecule is highly expressed specifically in the cancerous part even at the protein level and is highly expressed in the cancer cell lines, suggesting that the molecule is useful for diagnosis of cancer with a monoclonal antibody using tissue and serum specimens.

Example 12

12-1. Production of Anti-PEG10 Antibody

It has been suggested that there are two ORFs in TEG60: PEG10; ORF1 which is translated using standard codon usage and ORF2 which is newly translated by the occurrence of frameshift at the stop codon region in the ORF1 according to the report of mouse PEG10 (Shigemoto et al., Nucleic Acids Research, 29, 4079-4088, 2001), and the prediction from the genome sequence of human PEG10 (Ono et al., Genomics, 73, 232-237, 2001). However, the presence of ORF2 of human PEG10 has not been experimentally demonstrated. Accordingly, in order to demonstrate whether or not the frameshift in the ORF2 region actually occurs and whether or not the newly translated region is present in cancer tissue, an anti-PEG10/ORF2-monoclonal antibody was prepared based on the predicted ORF2 amino acid sequence.

```
ORF2 amino acid sequence
                                          (SEQ ID NO: 283)
QLSCQGLKVFAGGKLPGPAVEGPSATGPEIIRSPQDDASSPHLQVMLQIH

LPGRHTLFVRAMIDSGASGNFIDHEYVAQNGIPLRIKDWPILVEAIDGRP

IASGPVVHETHDLIVDLGDHREVLSFDVTQSPFFPVVLGVRWLSTHDPNI

TWSTRSIVFDSEYCRYHCRMYSPIPPSLPPPAPQPPLYYPVDGYRVYQPV

RYYYVQNVYTPVDEHVYPDHRLVDPHIEMIPGAHSIPSGHVYSLSEPEMA

ALRDFVARNVKDGLITPTIAPNGAQVLQVKRGWKLQVSYDCRAPNNFTIQ

NQYPRLSIPNLEDQAHLATYTEFVPQIPGYQTYPTYAAYPTYPVGFAWYP

VGRDGQGRSLYVPVMITWNPHWYRQPPVPQYPPPQPPPPPPPPPPPSYS

TL
```

12-2. Isolation of PEG10 cDNA

In order to express PEG10, PEG10 cDNA was first isolated as follows. A single-stranded cDNA was prepared from human fetal liver tissue according to the above-mentioned method. Then, PCR was carried out using the single-stranded cDNA as a template and primers F1 (SEQ ID NO: 284) and R1 (SEQ ID NO: 285). A band near about 2200 kbp was successfully detected, which agrees with that of the predicted sequence of PEG10. In the PCR method, a reaction mixture was prepared according to the protocol of an Advantage 2 cDNA PCR kit (manufactured by Clontech) and the reaction was carried out under the following conditions: an initial denaturation at 94° C. for 1 minute, 35 cycles of 94° C. for 30 seconds and 68° C. for 3 minutes, and a final extension reaction at 68° C. for 10 minutes. The specifically amplified fragment obtained by PCR was inserted into pGEM-T Easy (manufactured by Promega) by the TA cloning method, and the nucleotide sequence was checked by a standard method. The isolated cDNA was confirmed to be PEG10.

The primers F1 and R1 were designed to hybridize to the 5' end and 3' end of PEG10 gene (GenBank: AB049834), respectively.

SEQ ID NO: 284 (F1):
GGATCCATGACCGAACGAAGAAGGGACGAG

SEQ ID NO: 285 (R1):
TCTAGACAGGGTACTGTAAGATGGAGGCGG

12-3. Preparation of Antigen for Immunization Against PEG10/ORF2 and Production of Monoclonal Antibody To use as an antigen for immunization against PEG16/ORF2, a recombinant protein was prepared as a GST-binding protein using a partial sequence of the amino acids (ORF2/51 aa-251 aa).

More specifically, a gene encoding PEG10 (ORF2/51 aa-251 aa) was amplified by PCR using the above-mentioned PEG10 cDNA as a template and primers F2 (SEQ ID NO: 286) and R2 (SEQ ID NO: 287), and the amplified gene was inserted into pGEM-T Easy vector (manufactured by Promega). After the nucleotide sequence was confirmed by a standard method, the vector was digested with restriction enzymes BamHI and XhoI, and the digested gene fragment was inserted into pET41c vector (manufactured by Novagen) to construct an expression vector pETc_PEG10_ORF2.

SEQ ID NO: 286 (F2): GGATCCATCTTCCGGGCAGACACACCCT

SEQ ID NO: 287 (R2): CTCGAGTGCCATTTCAGGTTCGGACAGTG

A GST-binding PEG10_ORF2 protein was prepared using the expression vector pETc_PEG10_ORF2 and used to immunize mice to obtain a monoclonal antibody in the same manner as described above, whereby a monoclonal antibody H4128 against PEG10_ORF2 was prepared.

12-4. Detection of PEG10 Protein Molecule Using Anti-PEG10/ORF2 Antibody

In order to test the reactivity of the anti-PEG10/ORF2 antibody H4128 prepared as described above, PEG10 was measured in cell lysates from a cell line forcibly expressing PEG10 and a variety of cancer cell lines.

Figure 82:
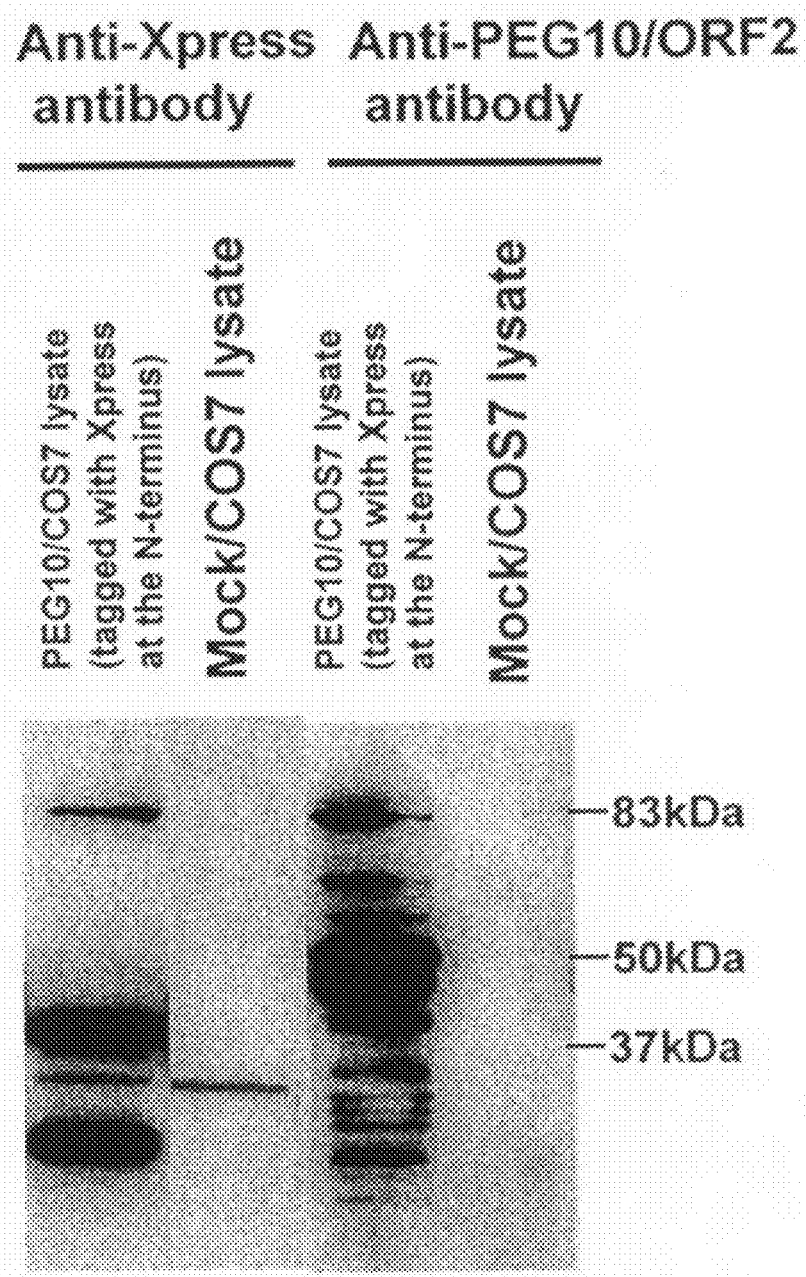
FIG. 82 shows the detection of a PEG10 protein molecule in a cell line forcibly expressing PEG10 and a variety of cancer cell lines using an anti-PEG10/ORF2 antibody.

First, the reactivity of the anti-PEG10/ORF2 antibody B0000A was examined by Western blot analysis using a COS7 cell forcibly expressing PEG10. A PEG10 gene expression vector pcDNA4/HisMax_PEG10_Full was obtained by inserting the cDNA encoding the full-length PEG10 into pcDNA4HisMaxC (manufactured by Invitrogen) and was used as an animal cell expression vector. This is a construct comprising an Xpress tag sequence inserted at the N-terminus of PEG10. More specifically, 1 µg of the expression vector pcDNA4/HisMax_PEG10_Full or pcDNA4 (Mock) as a negative control was introduced into 5×10⁴ COS7 cells and Hep3B cells using FuGene 6 reagent (manufactured by Roche Diagnostics) and the cells were made to transiently express PEG10. Three days after introduction of the expression vector, the cells were collected and solubilized in RIPA buffer (150 mM sodium chloride, 1% NP-40, 0.5% deoxycholic acid, 0.1% SDS, 50 mM tris hydroxyaminomethane hydrochloride (pH 8.0)) to prepare a cell lysate. Each lysate in an amount corresponding to 5 mg of proteins was loaded on a SDS-polyacrylamide gel and the protein was separated by SDS-PAGE and transferred to Hybond-P (manufactured by Amersham Biosciences). The protein was detected by ECL plus (manufactured by Amersham Biosciences) using the anti-Xpress antibody (1:5,000 dilution) (manufactured by Invitrogen) or the PEG10/ORF2 antibody H4128 (2 µg/mL) as a primary antibody and an HRP-labeled anti-mouse IgG antibody (manufactured by Amersham Biosciences) as a secondary antibody. Specific bands were detected near 83 kDa and 50 kDa, which are considered to be the PEG10 protein were specifically detected by the H4128 antibody, but not in the negative control (FIG. 82). In addition, a band near about 83 kDa was specifically detected in the same manner by the Xpress-tagged antibody labeled at the N-terminus. It is considered that the band near about 83 kDa may represent a full-length protein generated by the occurrence of frameshift downstream from ORF1 and being fused with ORF2. Further, since the amino acid sequence of the ORF2 region which was used as an antigen is not translated from a common frame, it was found by anti-PEG10/ORF2 antibody H4128 that frameshift occurs in human PEG10.

12-5. Expression Analysis of PEG10 Protein in Hepatocellular Carcinoma Tissue Using Anti-PEG10 Antibody H4128

Tissue extract from hepatocellular carcinoma and hepatoblastoma was analyzed by Western blot analysis with the anti-PEG10 antibody. Human tissue extract was prepared by adding RIPA buffer (150 mM sodium chloride, 1% NP-40, 0.5% deoxycholic acid, 0.1% SDS, 50 mM tris hydroxyaminomethane hydrochloride (pH 8.0)) to tissue fragments, followed by homogenization by sonication, and then collecting the supernatant fraction by centrifugation. The protein concentration was determined by the Bradford method for each extract sample, and the sample was adjusted at a concentration of 4 mg/mL. Then, the sample was mixed with an equal amount of SDS-sample buffer and heated at 95° C. for 5 minutes. Ten mg of each of the extract samples was applied to a 12% polyacrylamide gel and subjected to SDS-PAGE.

Figure 83:
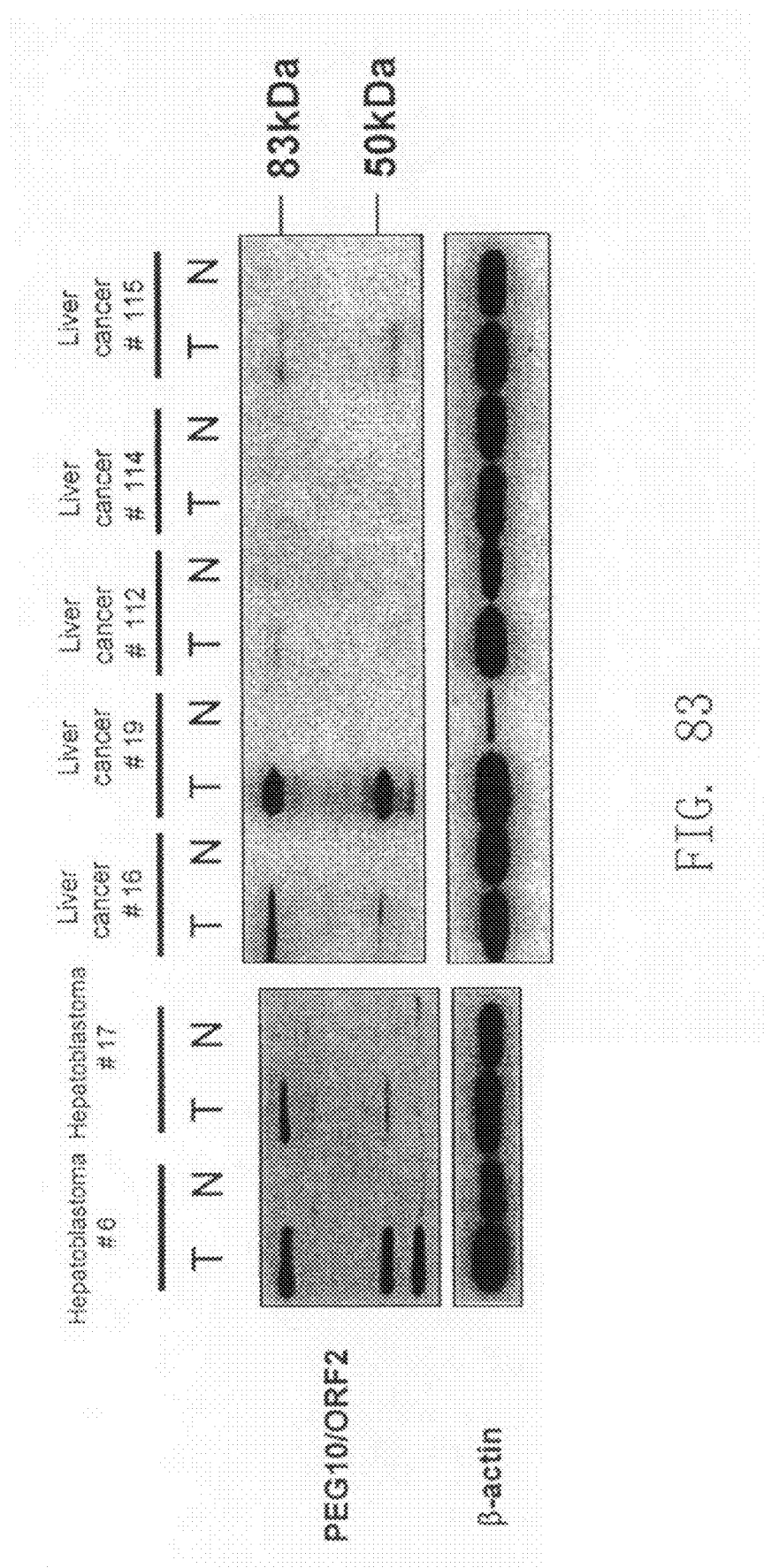
FIG. 83 shows the results of an expression analysis of PEG10 protein in hepatocellular carcinoma tissue using an anti-PEG10/ORF2 antibody.

The sample was analyzed by Western blot analysis with the anti-PEG10 antibody H4128 in the same manner as described above. Specific bands near 83 kDa and 50 kDa were detected specifically in the cancerous part (FIG. 83), demonstrating that not only forcibly expressed PEG10, but also PEG10/ORF2 are present in hepatocellular carcinoma and hepatoblastoma tissue.

From the above results, it was found that the TEG60: PEG10 molecule is highly expressed specifically in the cancerous part even at the protein level, suggesting that the molecule is useful in diagnosis of cancer with a monoclonal antibody using tissue and serum specimens.

Example 13

13-1. Preparation of Antigen for Immunization Against DUSP9 and Production of Monoclonal Antibody As for TEG63: DUSP9, in order to determine whether cancer can be detected by using a monoclonal antibody, an anti-DUSP9 antibody was prepared.

To use as an antigen for immunization against DUSP9, a recombinant protein was prepared as a GST fusion protein using the full-length sequence of DUSP9. More specifically, a gene encoding DUSP9 (385 aa) was amplified by PCR using HepG2 cDNA as a template and primers Ls772 (SEQ ID NO: 288) and Ls773 (SEQ ID NO: 289), and the amplified gene was inserted into pGEM-Te vector (manufactured by Promega). After the nucleotide sequence was confirmed by a standard method, the vector was digested with restriction enzymes EcoRI and HindIII, and the digested fragment was inserted into pET41a vector (manufactured by Novagen) to construct an expression vector pET41a-DUSP9.

SEQ ID NO: 288 (F): GAATTCATGGAGGGTCTGGGCCGCTC

SEQ ID NO: 289 (R): CTCGAGGGTGGGGGCCAGCTCGAAG

A GST-fused DUSP9 (1-385 aa) protein was prepared using the expression vector pET41a-DUSP9 in the same manner as described above and used for immunizing mice to produce a monoclonal antibody, whereby an anti-DUSP9 antibody #8901 was prepared.

13-2. Detection of DUSP9 Protein Molecule Using Anti-DUSP9 Antibody

In order to test the reactivity of the anti-DUSP9 antibody #8901 produced as described above, DUSP9 was measured in cell lysates of from a cell line forcibly expressing DUSP9 and a variety of cancer cell lines.

First, the reactivity of the anti-DUSP9 antibody #8901 was examined by Western blot analysis using a COS7 cell line forcibly expressing DUSP9. A DUSP9 gene expression vector pcDNA4-DUSP9 was constructed by inserting the cDNA encoding DUSP9 into pcDNA4Mys-His (manufactured by Invitrogen) was used as an animal cell expression vector. More specifically, 1 μg of the expression vector pcDNA4-DUSP9 was introduced into $5 \times 10^4$ COS7 cells by using FuGene 6 reagent (manufactured by Roche Diagnostics) and the cells were made to transiently express DUSP9. Three days after introduction of the expression vector, the cells were collected and were solubilized in RIPA buffer (150 mM sodium chloride, 1% NP-40, 0.5% deoxycholic acid, 0.1% SDS, 50 mM tris hydroxyaminomethane hydrochloride (pH 8.0)) to prepare a cell lysate. Each lysate in an amount corresponding to 3 mg of proteins was loaded on a SDS-polyacrylamide gel and the protein were separated by SDS-PAGE and transferred to Hybond-P (manufactured by Amersham Biosciences). The protein was detected by ECL plus (manufactured by Amersham Biosciences) using the DUSP9 antibody (1 μg/mL) as a primary antibody and an HRP-labeled anti-mouse IgG antibody (manufactured by Jackson) as a secondary antibody. A specific band was detected near about 42 kDa, which is considered to be the DUSP9 protein.

Figure 84:
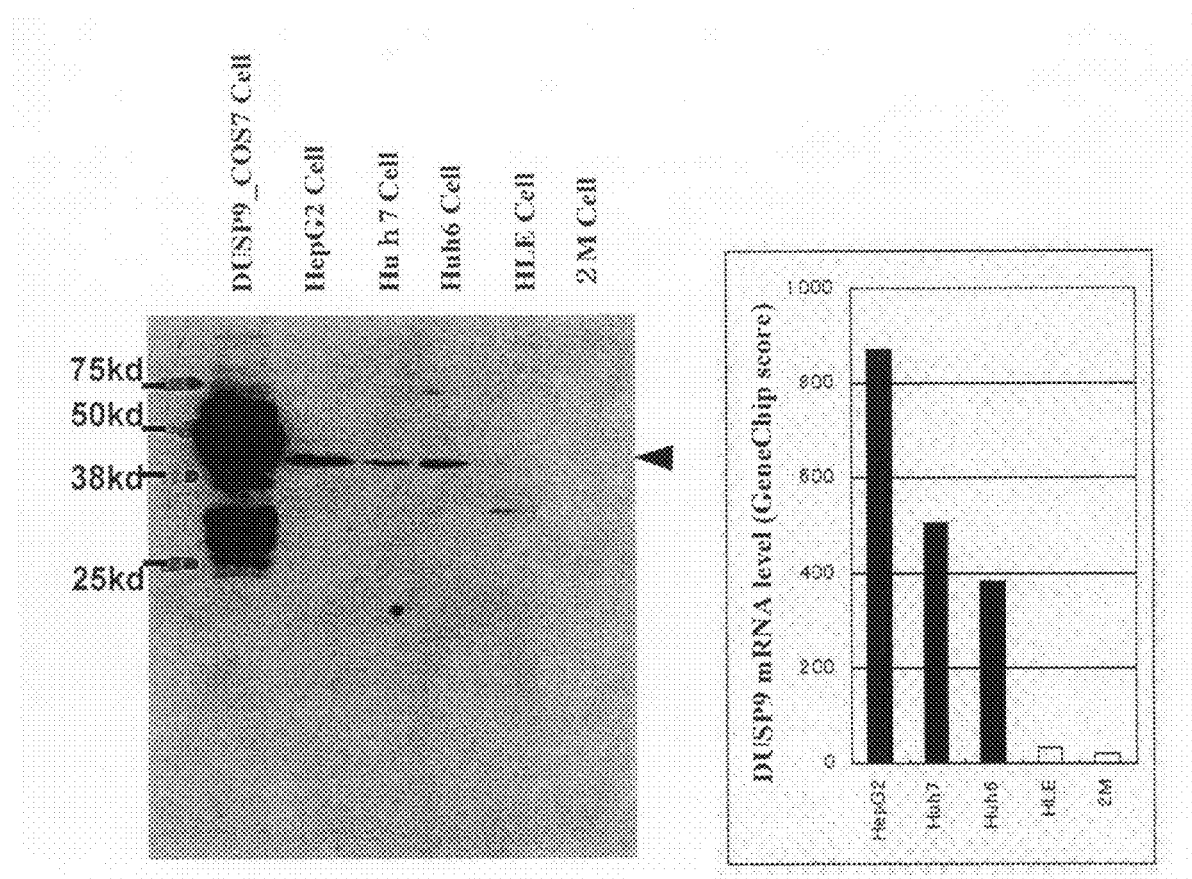
FIG. 84 shows the detection of a DUSP9 protein molecule in a cell line forcibly expressing DUSP9 and a variety of cancer cell lines using an anti-DUSP9 antibody.

In parallel, Western blot analysis was carried out for the cell lysates from a variety of cancer cell lines in the same manner. The result was consistent with the analysis results from GeneChip U133, namely, a band which is considered to be the full-length DUSP9 with a molecular weight of about 42 kDa was specifically and successfully detected only in the cell lines which showed a high mRNA expression score (FIG. 84).

13-3. Expression Analysis of DUSP9 Protein in Hepatocellular Carcinoma Tissue Using Anti-DUSP9 Antibody Tissue extract from hepatocellular carcinoma was analyzed by Western blot analysis with the anti-DUSP9 antibody #8901. Human tissue extract was prepared by adding RIPA buffer (150 mM sodium chloride, 1% NP-40, 0.5% deoxycholic acid, 0.1% SDS, 50 mM tris hydroxyaminomethane hydrochloride (pH 8.0)) to tissue fragments, followed by homogenization by sonication, and then collecting the supernatant fraction by centrifugation. The protein concentration was determined by the Bradford method for each extract sample, and the sample was adjusted at a concentration of 4 mg/mL. Then, the sample was mixed with an equal amount of SDS-sample buffer and heated at 95° C. for 5 minutes. Ten mg of each of the extract samples was applied to a 12% polyacrylamide gel and subjected to SDS-PAGE.

Figure 85:
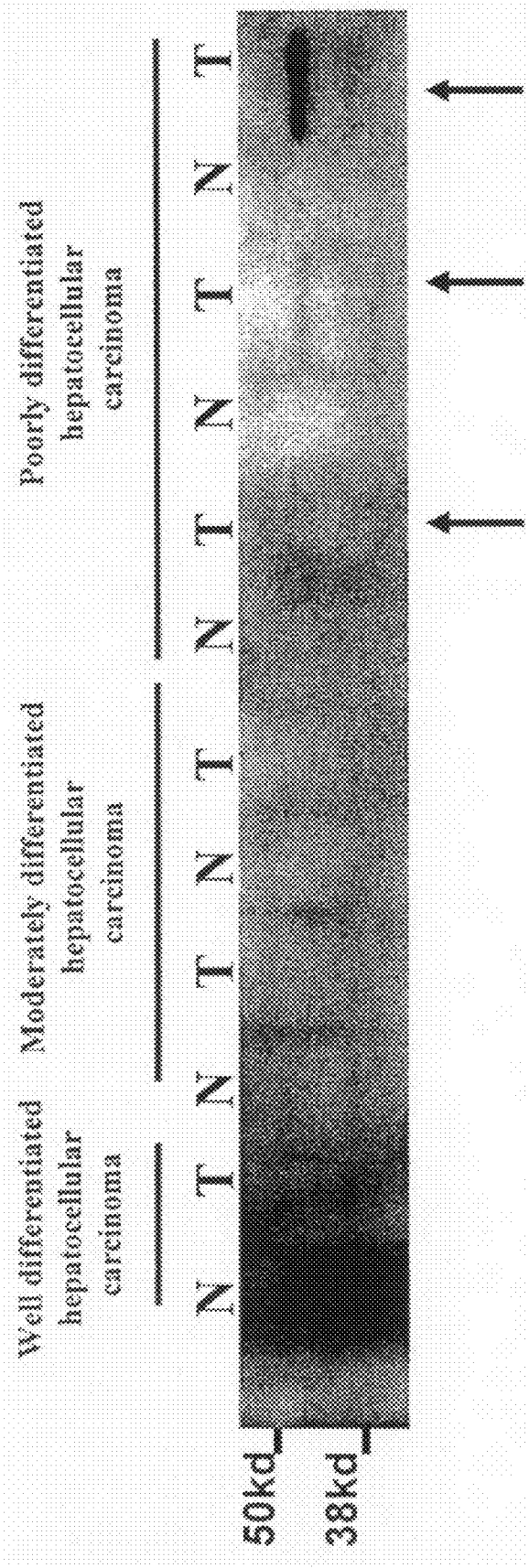
FIG. 85 shows the results of an expression analysis of DUSP9 protein in hepatocellular carcinoma tissue using an anti-DUSP9 antibody.

The sample was analyzed by Western blot analysis with the anti-DUSP9 antibody #8901 in the same manner as described above. A specific band near 42 kDa was detected specifically in the cancerous part (FIG. 85). Particularly, the band was detected in 3 cases out of 3 cases of the poorly differentiated hepatocellular carcinoma.

From the above results, it was demonstrated that the TEG63:DUSP9 molecule is highly expressed in the cancerous part. Moreover, its expression is elevated in the cancerous part as well as in the cancer cell lines even at the protein level as detected by the monoclonal antibody, suggesting that the molecule is useful for diagnosis of cancer with a monoclonal antibody using tissue and serum specimens.

Example 14

14-1. Production of Anti-Cystatin SN Antibody

As for TEG47: cystatin SN, in order to determine whether cancer can be detected by using an anti-cystatin SN antibody, an anti-cystatin SN antibody was prepared.

More specifically, a peptide was synthesized by a standard method with a partial sequence of the amino acids (from 60 aa to 75 aa) of cystatin SN to be used as an antigen for immunization against cystatin SN (see GenBank No. NM_001898). C: cysteine residue was added at the N-terminus of the peptide, and the peptide was conjugated to Keyhole limpet hemocyanin (KLH), which was used as an immunogen. A monoclonal antibody was produced in the same manner as described above and a monoclonal antibody was successfully isolated. Peptide sequence: C-KDDYYRRPLRVLRARQ (SEQ ID NO: 290)

Figure 86:
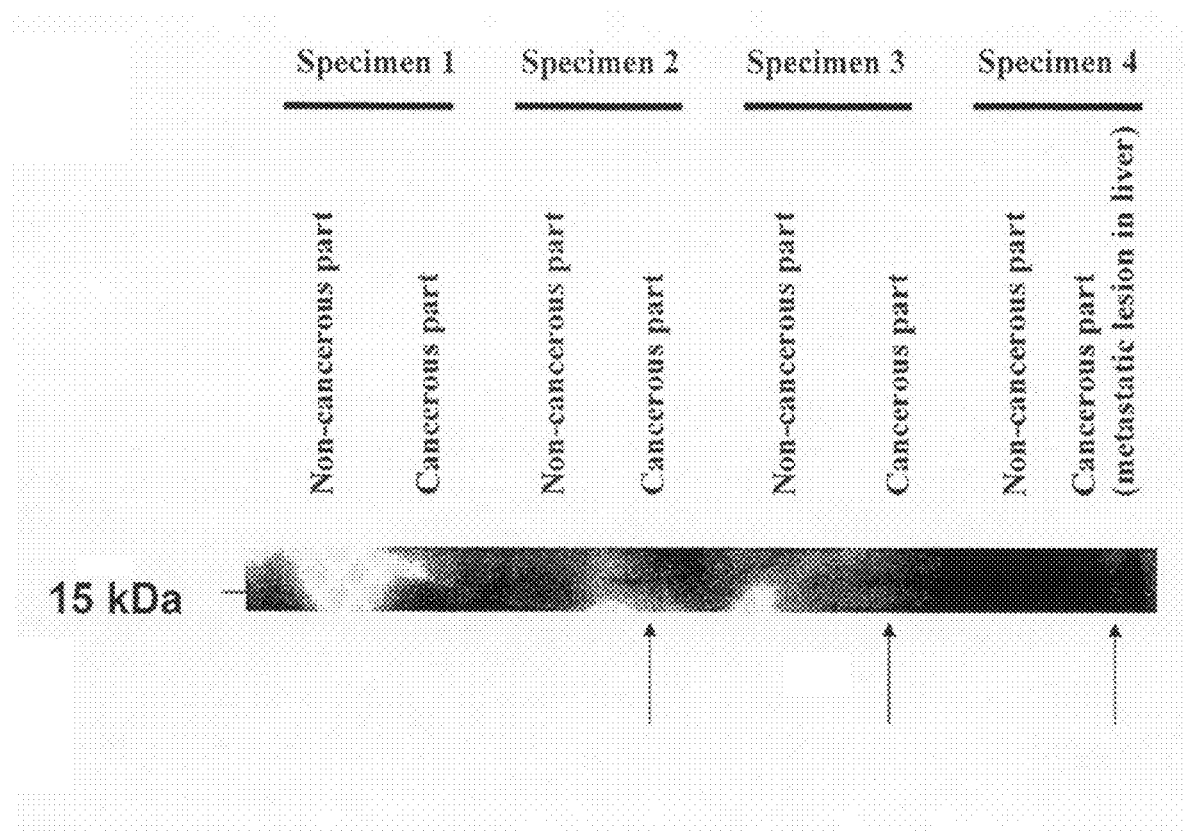
FIG. 86 shows the results of an expression analysis of Cystatin SN protein in large bowel cancer tissue using an anti-Cystatin SN antibody.

14-2. Expression Analysis of Cystatin SN Protein in Large Bowel Cancer Tissue Using Anti-cystatin SN Antibody Tissue extract from large bowel cancer was analyzed by Western blot analysis with the anti-cystatin SN antibody. Human tissue extract was extracted in the same manner as described above. The samples was analyzed by Western blot analysis with the anti-cystatin SN antibody (4 μg/mL). A specific band near 15 kDa was detected specifically in the cancerous part (FIG. 86). Since the predicted molecular weight of cystatin SN is about 16 kDa, it was found that the expression of cystatin SN is elevated specifically in the cancerous part.

From the above results, it was found that the TEG47: cystatin SN molecule is highly expressed specifically in the cancerous part at the protein level, suggesting that the molecule is useful for diagnosis of cancer with a monoclonal antibody using tissue and serum specimens.

Example 15

Production of Anti-SFRP4 Antibody

As for TEG56: SFRP4, in order to determine whether cancer can be detected by using an anti-SFRP4 antibody, an anti-SFRP4 antibody was prepared.

15-1. Isolation of SFRP4 cDNA

In order to express SFRP4, SFRP4 cDNA was first isolated as follows. A single-stranded cDNA was prepared from stomach cancer tissue according to the above-mentioned method. Then, PCR was carried out using the single-stranded cDNA as a template and primers GC898 (SEQ ID NO: 291) and GC899 (SEQ ID NO: 292) with a restriction enzyme site for EcoRI or XhoI. A band near about 1000 bp corresponding to a desired size was successfully detected. The enzymes and reagents used in PCR included Advantage HF Polymerase Mix (manufactured by Clontech), Advantage HF PCR buffer, 200 µM deoxynucleotide triphosphate and 0.2 µM primer. PCR was carried out using 1 µL of the cDNA as a template (35 cycles of 94° C. for 30 seconds, 68° C. for 30 seconds and 72° C. for 3 minutes). The specifically amplified fragment obtained by PCR was inserted into pGEM-T Easy vector (manufactured by Promega) using a DNA ligation kit (manufactured by Takara), and the nucleotide sequence was checked by a standard method. The isolated cDNA was found to correspond to SFRP4.

The primers GC898 and GC899 were designed to hybridize with the 5' end and 3' end of SFR4_ORF gene (GenBank: NM_003014), respectively,

```
SEQ ID NO: 291 (GC898):
CGGGATCCATGTTCCTCTCCATCCTAGTGG

SEQ ID NO: 292 (GC899):
CGCTCGAGACACTCTTTTCGGGTTTGTTC
```

15-2. Preparation of Antigen for Immunization Against SFRP4

To use as an antigen for immunization against SFRP4, a recombinant protein was prepared as a GST-binding protein using the full-length SFRP4 sequence. More specifically, the above-mentioned SFRP4 sequence was inserted into pGEM-T and digested with restriction enzymes EcoRI and XhoI. Then, the digested gene fragment was inserted into pET41a vector (manufactured by Novagen) to construct an expression vector GST-SFRP4.

Preparation of a GST fusion antigen protein and production of a monoclonal antibody by immunizing mice were carried out in the same manner as described above, whereby an anti-SFRP4 monoclonal antibody A7113 was prepared.

Figure 87:
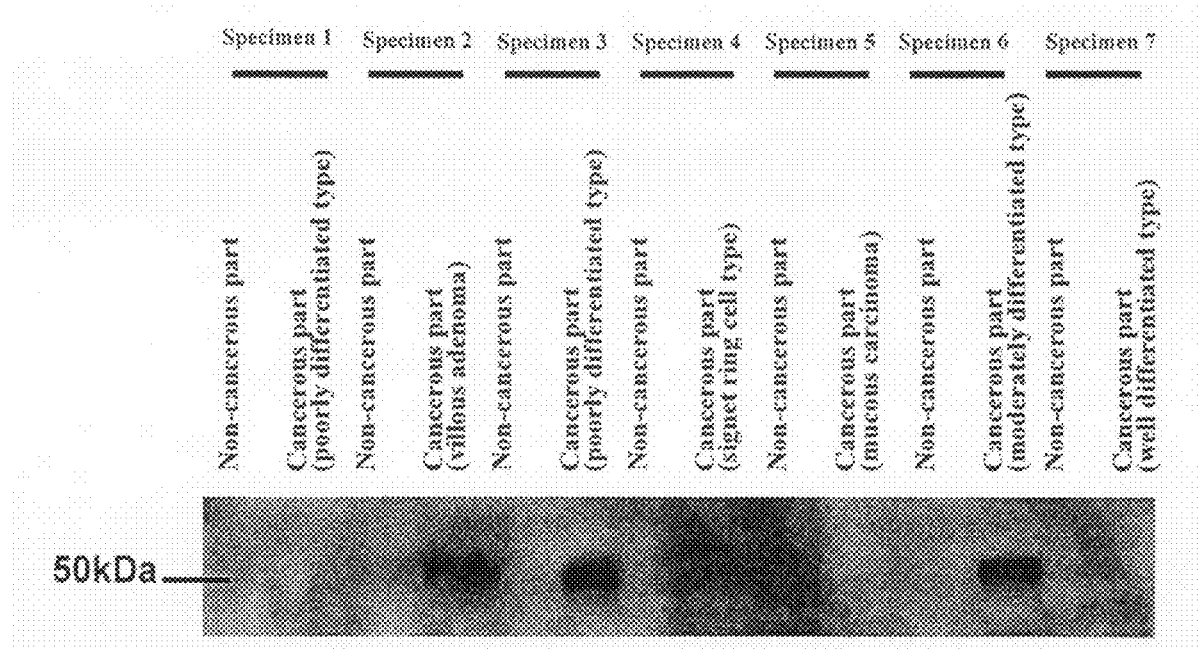
FIG. 87 shows the results of an expression analysis of SFRP4 protein in stomach cancer tissue using an anti-SFRP4 antibody.

15-3. Expression Analysis of SFRP4 Protein in Stomach Tissue Using Anti-SFRP4 Antibody Tissue extract from stomach cancer was analyzed by Western blot analysis with the anti-SFRP4 antibody. The Western blot analysis with the anti-SFRP4 antibody A7113 (40 µg/mL) was carried out in the same manner as described above. A specific band near about 50 kDa was detected in the cancerous part (FIG. 87).

Figure 88:
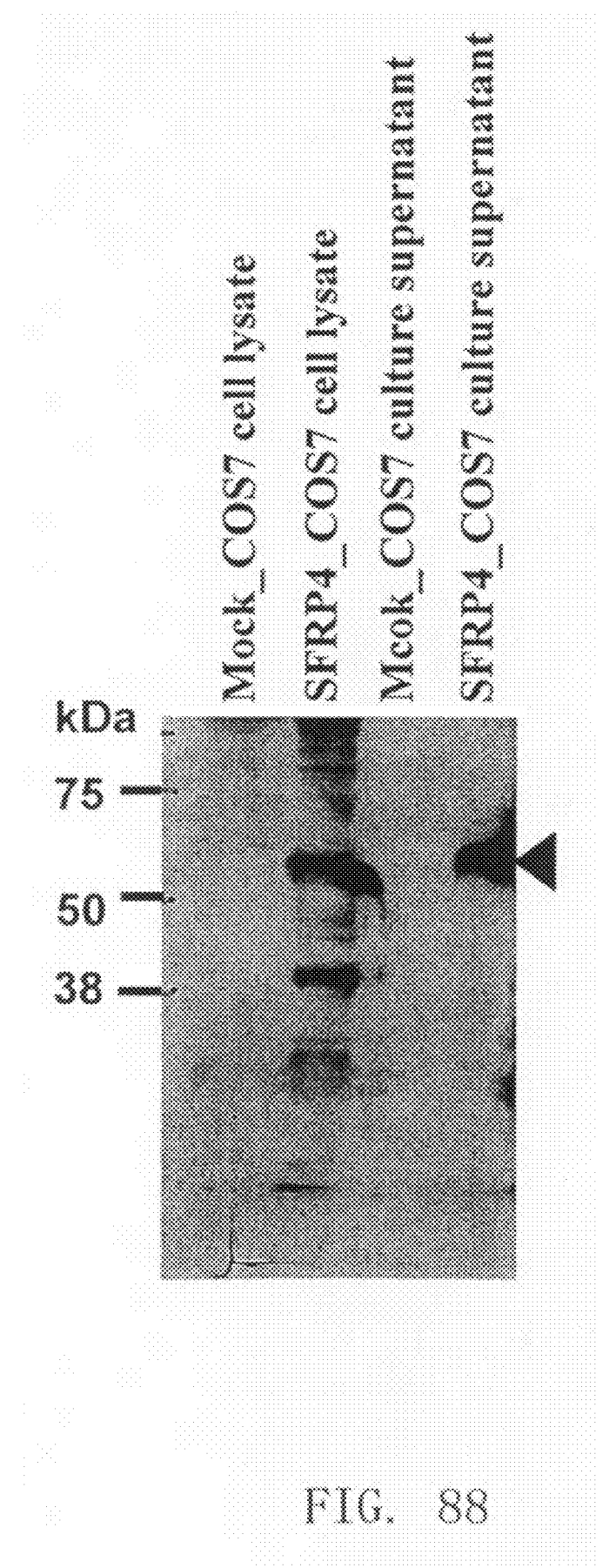
FIG. 88 shows the detection of a SFRP4 protein molecule in a culture supernatant of COS7 cells which were forcibly made to express SFRP4 using an anti-SFRP4 antibody.

In parallel, the SFRP4 sequence cloned as described above was inserted into an expression vector to prepare an expression vector SFRP4_pcDNA4His-Myc (manufactured by Invitrogen). COS7 cells were forcibly made to express the vector and a lysate of the COS7 cells was analyzed by Western blot analysis with the anti-Myc antibody (1:5,000 dilution, Invitrogen). A band with the same size as the one detected in a clinical specimen was detected (FIG. 88). Accordingly, the band of 50 kDa detected by the anti-SFRP4 monoclonal antibody in the clinical specimen is considered to be SFRP4. It was found that an elevation in the expression of SFRP4 in the cancerous part was specifically detected by the monoclonal antibody. Further, the culture supernatant of COS7 cells forcibly made to express SFRP4 was analyzed and it was found that SFRP4 having a signal sequence is secreted in the culture supernatant (FIG. 88).

From the above results, it was shown that the TEG56: SFRP4 molecule is highly expressed specifically in the cancerous part even at the protein level, and is secreted in the cancer cell, suggesting that the molecule is useful for diagnosis of cancer with a monoclonal antibody using tissue and serum specimens.

INDUSTRIAL APPLICABILITY

The gene, protein, and antibody of the present invention can be used in diagnosis and treatment of cancer, as well as development of a therapeutic drug of cancer.

SEQUENCE LISTING (292 sequences)

SEQ ID NO: 1 - DNA, 19341 bp, homo sapiens
agtaagaatcagcagcgcgggcaaggagtacggacgggagtcagaggcagagcgagggtgtgtggagggccggcggggaccgccgggagcgcgcggatgtcggtgttcctggggccagggatgccctctgcatctttattagtaaatcttctttcagctttactcatcctatttgtgtttggagaaacagaaataagatttactggacaaactgaatttgttgttaatgaaacaagtacaacagttattcgtcttatcattgaaaggataggagagccagcaaatgttactgcaattgtatcgctgtatggagaggacgctggtgacttttttgacacatatgctgcagcttttatacctgccggagaaacaaacagaacagtgtacatagcagtatgtgatgatgacttaccagggcctgacgaaacttttatttttcacttaacattacagaaaccttcagcaaatgtgaagcttggatggccaaggactgttactgtgacaatattatcaaatgacaatgcatttggaattatttcatttaatatgcttccctcaatcgcagtgagtgagcccaagggcagaaatgagtctatgcctcttactctcatcagggaaaagggaacctatggaatggtcatggtgacttttgaggtagagggtggcccaaatccccctgatgaagatttgagtccagttaaaggaaatatcacctttccccctggcagagcaacagtaatttataacttggcagtactcgatgacgaggtaccagaaaatgatgaaatatttttaattcaactgaaaagtgtagaaggaggagctgagattaacacctctaggaattccattgagatcatcattgagaaaaatgatagtcccgtgagattccttcagagtatttatttggttcctgaggaagaccacatactcataattccagtagttcgtggaaaggacaacaatggaaatctgattggatctgatgaatatgaggtttcaatcagttatgctgtcacaactgggaattccacagcacatgcccagcaaaatctggacttcattgatcttcagccaaacacaactgttgtttttccaccttttattcatgaatctcacttgaaatttcaaatagttgatgacaccataccggagattgctgaatcgtttcacattatgttactaaaagataccttacagggagatgctgtgctaataagcccttctgttgtacaagtcaccattaagccaaatgataaaccttatggagtcctttcattcaacagtgttttgtttgaaaggacagttataattgatgaagatagaatatcaagatatgaagaaatcacagtggttagaaatggaggaacccatgggaatgtctctgcgaattgggtggtgacaccgaacagcactgatccctcaccagtaacagcagatatcagaccgagctctggagttcttcattttgcacaagggcagatgttggcaacaattcctcttactgggggtgatgatgatcttccagaagaggcagaagcttatctacttcaaattctgcctcatacaatacgaggaggtgcagaagtgagcgagccagcggagcttttgttctacattcaggatagtgatgatgtctatggcctaataacattttttcctatggaaaaccagaagattgaaagcagcccaggtggacgatacttatccttgagttttacaagactaggagggactaaaggagatgtgaggttgctttattctgtactttacattcctgctggagctgtggaccccttgcaagcaaaagaaggcatcttaaatatatcaaggagaaatgacctcatttttccagagcaaaaaactcaagtcactacaaaattaccaataagaaatgatgcattccttcaaaatggagctcactttctagtacagttggaaactgtggagttgttaaacataattcctctaatcccacccataagccctagatttggggaaatctgcaatatttctttactggttactccagccattgcaaatggagaaattggctttctcagcaatcttccaattattttgcatgaaccagaagattttgctgctgaagtggtatacattcccttacatcgggatggaactgatggccaggctactgtctactggagtttgaagccctctggctttaattcaaaagcagtgaccccggatgatataggcccctttaatggctctgttttgtttttatctgggcaaagtgacacaacaatcaacattactatcaaaggtgatgacataccggaaatgaatgaaactgtaacactttctctagactgggttaacgtggaaaaccaagtgctgaaatctggatatactagccgtgacctaattattttggaaaatgatgaccctgggggagtttttgaattttctcctgcttccagaggaccctatgttataaaagaaggagaatctgtagagctccacatcatccgatcaagggggtcccttgttaagcagtttctacactaccgagtagagccaagagatagcaatgaattctatggaaacacgggagtactagaatttaaacctggagaaagggagatagtgatcaccttgctagcaagattggatgggataccagagttggatgaacactactgggtggtcctcagcagccacggagaacgggaaagcaagttgggaagtgccaccattgtcaatataacgattctgaaaaatgatgatcctcatggcattatagaatttgtttctgatggtctaattgtgatgataaatgaaagcaaaggagatgctatctatagtgctgtttatgatgtagtaagaaatcgaggcaactttggtgatgttagtgtatcatgggtggttagtccagactttacacaagatgtatttcctgtacaagggactgttgtctttggagatcaggaattttcaaaaaatatcaccatttactcccttccagatgagattccagaagaaatggaagaatttaccgttatcctactgaatggcactggaggagctaaagtgggaaatagaacaactgcaactctgaggattagaagaaatgatgaccccatttattttgcagaacctcgtgtagtgagggttcaagaaggggagactgccaactttacagttctcagaaatggatctgttgatgtgacttgcatggtccagtatgctaccaaggatgggaaggctactgcaagagagagagatttcattcctgttgaaaaaggagaaacgctcatttttgaggttggaagtagacagcagagcatatccatatttgttaatgaagatggtatcccggaaacagatgagcccttttatataatcctcttgaattcaccaggtgatccagtagtatatcaatatggagtagctacagtaataattgaagctaatgatgacccaaatggcattttttctctggagcccatagacaaagcagtggaagaaggaaagactaatgcattttggattttgaggcaccgaggatactttggtagtgtttctgtatcttggcagctctttcagaatgattctgctttgcagcctgggcaggagttctatgaaacttcaggaactgttaacttcatggatggagaagaagcaaaaccaatcattctccatgcttttccagataaaattcctgaattcaatgaattttatttcctaaaacttgtaaacatttcaggtggatccccaggtcctgggggccagctagcagaaaccaacctccaggtgacagtaatggctccattcaatgatgatccctttggagtttttatcttggatccagagtgtttagagagagaagtggcagaagatgtcctgtctgaagatgatatgtcttatattaccaacttcaccattttgaggcagcagggtgtgtttggtgatgtacaactgggctgggaaatactgtccagtgagttccctgctggtctgccaccaatgatagattttttactggttggaattttccccaccaccgtgcatttacaacagcacatgcggggtcaccacagtggaacggatgctttgtactttaccggactagaaggtgcatttgggactggtaattcaaaataccatcccttcaggaataatacaattgccaactttacattttcagcttgggtaatgcccaatgccaatacgaatggattcattatagcgaaggatgacggtaatggaagcatctactacggggtaaaaatacaaacaaacgaatcccatgtgacactttcccttcattataaaaccttgggttccaatgctacatacattgccaagacaacagtcatgaaatatttagaagaaagtgtttggcttcatctactaattatcctggaggatggtataatcgaattctacctggatggaaatgcaatgcccaggggaatcaagagtctgaaaggagaagccattactgacggtcctgggatactgagaattggagcagggataaatggcaatgacagatttacaggtctgatgcaggatgtgaggtcctatgagcggaaactgacgcttgaagaaatttatgaacttcatgccatgcccgcaaaaagtgatttacacccaatttctggatatctggagttcagacagggagaaactaacaaatcattcattatttctgcaagagatgacaatgacgaggaaggagaagaattattcattcttaaactagtttctgtatatggaggagctcgtatttcggaagaaaatactactgcaagattaacaatacaaaaaagtgacaatgcaaatggcttgtttggtttcacaggagcttgtataccagagattgcagaggagggatcaaccatttcttgtgtggttgagagaaccagaggagctctggattatgtgcatgttttttacaccatttcacagattgaaactgatggcattaattaccttgttgatgactttgctaatgccagtggaactattacattccttccttggcagagatcagaggttctgaatatatatgttcttgatgatgatattcctgaacttaatgagtatttccgtgtgacattggtttctgcaattcctggagatgggaagctaggctcaactcctaccagtggtgcaagcatagatcctgaaaaggaaacgactgatatcaccatcaaagctagtgatcatccatatggcttgctgcagttctccacagggctgcctcctcagcctaaggacgcaatgaccctgcctgcaagcagcgttccacatatcactgtggaggaggaagatggagaaatcaggttattggtcatccgtgcacagggacttctgggaagggtgactgcggaatttagaacagtgtccttgacagcattcagtcctgaggattaccagaatgttgctggcacattagaatttcaaccaggagaaagatataaatacattttcataaacatcactgataattctattcctgaactggaaaaatcttttaaagttgagttgttaaacttggaaggaggagtagctgaactctttagggttgatggaagtggtagtggtgatggggacatggaattcttccttccaactattcacaaacgtgccagtctaggagtggcttcccaaattctagtgacaattgcagcctctgaccacgctcatggcgtatttgaatttagccctgagtcactctttgtcagtggaactgaaccagaagatgggtatagcactgttacattaaatgttataagacatcatggaactctgtctccagtgactttgcattggaacatagactctgatcctgatggtgatctcgccttcacctctggcaacatcacatttgagattgggcagacgagcgccaatatcactgtggagatattgcctgacgaagacccagaactggataaggcattctctgtgtcagtcctcagtgtttccagtggttctttgggagctcatattaatgccacgttaacagttttggctagtgatgatccatatgggatattcattttttctgagaaaaacagacctgttaaagttgaggaagcaacccagaacatcacactatcaataataaggttgaaaggcctcatgggaaaagtccttgtctcatatgcaacactagatgatatggaaaaaccaccttattttccacctaatttagcgagagcaactcaaggaagagactatataccagcttctggatttgctctttttggagctaatcagagtgaggcaacaatagctatttcaattttggatgatgatgagccagaaaggtccgaatctgtctttatcgaactactcaactctactttagtagcgaaagtacagagtcgttcaattccaaattctccacgtcttgggcctaaggtagaaactattgcgcaactaattatcattgccaatgatgatgcatttggaactcttcagctctcagcaccaattgtccgagtggcagaaaatcatgttggacccattatcaatgtgactagaacaggaggagcatttgcagatgtctctgtgaagtttaaagctgtgccaataacagcaatagctggtgaagattatagtatagcttcatcagatgtggtcttgctagaaggggaaaccagtaaagccgtgccaatatatgtcattaatgatatctatcctgaactggaagaatcttttcttgtgcaactgatgaatgaaacaacaggaggagccagactaggggctttaacagaggcagtcattattattgaggcctctgatgacccctatggattatttggttttcagattactaaacttattgtagaggaacctgagtttaactcagtgaaggtaaacctgccaataattcgaaattctgggacactcggcaatgttaccgttcagtgggttgccaccattaatggacagcttgctactggcgacctgcgagttgtctcaggtaatgtgacctttgcccctggggaaaccattcaaaccttgttgttagaggtcctggctgacgacgttccggagattgaagaggttatccaagtgcaactaactgatgcctctggtggaggtactattgggttagatcgaattgcaaatattattattcctgccaatgatgatccttatggtacagtagcctttgctcagatggtttatcgtgttcaagagcctctggaaagaagttcctgtgctaatataactgtcaggcgaagcggagggcactttggtcggctgttgttgttctacagtacttccgacattgatgtagtggctctggcaatggaggaaggtcaagatttactgtcctactatgaatctccaattcaaggggtgcctgacccactttggagaacttggatgaatgtctctgccgtgggggagcccctgtatacctgtgccactttgtgccttaaggaacaagcttgctcagcgttttcatttttcagtgcttctgagggtccccagtgtttctggatgacatcatggatcagcccagctgtcaacaattcagacttttggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacaatattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattttgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgtgggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaatagagccacctccatagacatcgaagaagccaataggaccgtgtatttaaatgtatctcgaactaatgacattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtacaaacaatcattattctggaaagttctcaagtaagatattttacttcagacagccaagattatttaatcattgcaagtcaaagagatgattccgaattaactcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccgaaaatgtctttctaggagatcagaattcaattgatattttcatctgggagatgggacagtcttccttcaggtattttcagtctgtagattttgctgctgttaacagaatccactccttcacaccagcctcaggaatagcccacatacttcttattgggccaagatatgtctactcttttactgctggaaattcggagcgtaatcaattctcttttgttctggaagtaccttctgcttatgatgtggtttctgttacagtaaagtcccttaattcaagcaagaatttaatagctctagtgggagctcattcacatatatatgagctagcctacatttccagccattctgactttattcctagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagaggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaatgattgatgaatccctttcatccgatgaccctgattcatatgtgacattgacggttgtccggtccccaggaggaaaaggaaccgtccgacttgagtggaccatagatgagaaggctaaacataaccttagtcctttgaatgggacccttcattttgatgagactgagtcccagaagaccattgtgttgcacacacttcaagacacagtgttggaggaggacaggcgtttcaccattcagctgatatcaattgatgaggtagaaatatctccagtaaaaggtagtgcatcaataattattcggggtgataagcgagcatcaggagaagttgggatagctccgtcatctaggcacatcctcattggggaaccctcagcaaaatataatggtaccgctattatcagccttgttcgaggcccagggattttgggggaggtcacagtgttctggaggatattccctccttccgtgggggaatttgctgaaacatcaggaaaactgacaatgcgagacgaacagtctgcagtcattgtagtaatacaggctttgaacgatgacattcccgaggaaaaaagcttctatgagtttcagctcactgcagtcagtgggggaggagttctgagtgaatccagcagcactgccaacatcacggtggtggccagcgactctccctatggccgatttgccttttcacatgagcaacttcgagtgtcagaagcacagagggttaacatcacaatcatccgttccagtggagattttggccatgtgcgactctggtacaagacgatgagcgggacagcggaagcaggcttggattttgttcctgcagcaggggagctcctctttgaagcaggggagatgaggaaaagtctgcatgttgaaatccttgatgatgactatcctgaaggcccagaggaattttctctaacaattacaaaggtggaactccagggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggggaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctgatggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatctaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtgattgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatctaaaaaa

SEQ ID NO: 2 - DNA, 1952 bp, homo sapiens
cttccgcggaagggaagagtcccgcagtcggaggcggccggctgggcgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggcacttttcctgcaactcggcggcgccacgcggcccgccggccacgcgccctgggacaaccacgtctccggccacgccctgttcacagagacaccccatgacatgacagcacggacgggcgaggacgtggagatggcctgctccttccgcggcagcggctccccctcctactcgctggagatccagtggtggtatgtacggagccaccgggactggaccgacaagcaggcgtgggcctcgaaccagctaaaagcatctcagcaggaagacgcagggaaggaggcaaccaaaataagtgtggtcaaggtggtgggcagcaacatctcccacaagctgcgcctgtcccgggtgaagcccacggacgaaggcacctacgagtgccgcgtcatcgacttcagcgacggcaaggcccggcaccacaaggtcaaggcctacctgcgggtgcagccaggggagaactccgtcctgcatctgcccgaagcccctcccgccgcgcccgccccgccgccccccaagccaggcaaggagctgaggaagcgctcggtggaccaggaggcctgcagcctctagactgatgcccctgcccccgcccatccgcccccacgctgtacagagtgcatgaggagccgccggaccaccggggaccgactgcctgcgtccagccgcgccccatccccgaggccgcctgtggccaccatgtcggccctctttccaccaccccttgctcagcatgtaagccccacccacccctgccctttcagacccctgcggtgacctggctcggagaaggtggccctgggcaccaaggggccaaccgccctgaacactggggcagggaccatgctggggcccggggccacccccttcctgtcaccagcttctgtggagtccagtgttttgctttgcttgcttgtcccccatcctgtcctgagccggggccccccagcctcgcctccctcctcctaccatccctcacttggacctgggggtgtggacagtgacccctccctgaatatggacttgaatcttctgagcagaactagggcctctcccctggtgaagacccagggaacccaggagggcccttctggggcagtggctctgcagggtcactcatggaggcctaggggaacagcgagatgccccaccacctcctggcgagtccttcctgttcagctccctgtgcgaccctccagggatgcaggggatccaggattctctgccctgtcacacggcgagtcagaagggaggggcctttccctcggacccatggccccaggcagagttttgcaccagcaggacccctttgagggccttcaaggctctcccaggagtccccctctgccggccccccaatgccccagctccctcttgggtcctgtgccaagtccgccccagggcctggggctgttgggagccaagggccccctggtactcagttccctcacgattcccgatcacgggcacacctgccccctggttatttgtaaatatttctattggacccaattctcctcggaattggctggcacctctggttgccacagctcagtgatgacgtgggggaggtgggagaggccgagggctttgcctaggggtgggttgccctgtatacatgatccagtctgtgactaccagccaacctgaataaagcggtttt

SEQ ID NO: 3 - DNA, 932 bp, homo sapiens
gggcgtgagaaaggcgacggcggcggcgcggaggagggttatctatacatttaaaaaccagccgcctgcgccgcgcctgcggagacctgggagagtccggccgcacgcgcgggacacgagcgtcccacgctccctggcgcgtacggcctgccaccactaggcctcctatccccgggctccagacgacctaggacgcgtgccctggggagttgcctggcggcgccgtgccagaagcccccttggggcgccacagttttccccgtcgcctccggttcctctgcctgcaccttcctgcggcgcgccgggacctggagcgggcgggtggatgcaggcgcgatggacggcggcacactgcccaggtccgcgccccctgcgccccccgtccctgtcggctgcgctgcccggcggagacccgcgtccccggaactgttgcgctgcagccggcggcggcgaccggccaccgcagagaccggaggcggcgcagcggccgtagcgcggcgcaatgagcgcgagcgcaaccgcgtgaagctggtgaacttgggcttccaggcgctgcggcagcacgtgccgcacggcggcgccagcaagaagctgagcaaggtggagacgctgcgctcagccgtggagtacatccgcgcgctgcagcgcctgctggccgagcacgacgccgtgcgcaacgcgctggcgggagggctgaggccgcaggccgtgcggccgtctgcgccccgcgggccgccagggaccaccccggtcgccgcctcgccctcccgcgcttcttcgtccccgggccgcgggggcagctcggagcccggctccccgcgttccgcctactcgtcggacgacagcggctgcgaaggcgcgctgagtcctgcggagcgcgagctactcgacttctccagctggttagggggctactgagcgccctcgaccta

SEQ ID NO: 4 - DNA, 459 bp, homo sapiens
ggagagacaagggactccctatgttactcctggactaaagcaatcctcccacattggctttccaaagtgctgaggtcacaggcacaagcccctgcgcccgaccacaagtaggtgttttaaaccagtgtttttttttaacaaggcacaaacattcgacttaagggtgacagcatagtactttaccaggaataaagttatgttttacacatatacacgtggaaaaaattaaaaccctatgaagttggtattgtcttatattaagtaatgaggaaactgaggcataaagtagctaaggattttgttcaaagagcaagtgatggcataatcagaacttgaacccaggtctacccagcatcagagcccatattcctaatccccacactggggctgcaggaggaaattaatggaaggattcccacaaaacaagacaaatcttttaccatataaataaattcacat

SEQ ID NO: 5 - DNA, 667 bp, homo sapiens
  misc_feature (435)..(435): n is a, g, c or t
  misc_feature (652)..(652): n is a, g, c or t
tcgacccacgcgtccgtattatccacttcctctctctctatctttagtattttaaagtaaatcccagatagcatcacatcatttcacccccaccataggatttcaaagatctgttatatttcaagattgagtaaaagggcttgaaattgggttattgcaatgaaactctagaaaaagcttgagggttcacccaggagtaagctggacaaaaaaggggtttgaggggtggacccatcttgcctaaaaatcttgtctcatctttctaaaaattacatatgaaagaggaagatttatgttacttttttatatgagagaatcgtcctttaatagaaaatttctattgctgcatcagaattatggaggaacacaaaaaacatacctcagtccttagtgtgtcctaaattaacacatattcacttattagtgggtaaatgnctatatttcatttcagcacaacttctcccctggtagaaactcaaaagaaatttctaatgattaaactagggaagttgcactggaattggatggcttatcagagcaaccgcagttttccaggaaggaaattccaatggccatgcggttggaaaattccccctagcaaataagggattaatttttaaaaaaggaaggataaaggaggtctgggttcttntggttttaaaaaaaa

SEQ ID NO: 6 - DNA, 418 bp, homo sapiens
ttttatagtgctgtatttgtattgggtgaatatgtggaaattagggagttctatgcttttgatagagacaggccaatttacttgctcatccttgaatgcaggtttcttgacattccttttcactgttgaatctatttcctgagccattacagccactgaaccaaaatcgggcacaagagttgacctgtttgtcataataccatcgaaccacatattcaccacagtttccaggcttcaaggcttccaaacatctaggatcctctgccccatccacaggggtgctgagcagtggcctgggggtggtggtggcctcagatgaggtagtggcaggcacatcatcagcccacgttggctctggagccttatcatcttcatcctggtctctggtgacactcaatgactcagaaatttctttttg

SEQ ID NO: 7 - DNA, 1665 bp, homo sapiens
caacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctaggcagactgtctggaggaggagccggcactgaggggcccagacacccgctgccccagtgccacctcaccccccaccagcaggccctcccgtctcttcgggacagggccccagccgtcccccctgtctgggtctgcccactgccctcctgccccggctttccctgcccctctcccacagcccagccagagacaagggacctgctgtcatccccatctgtggcctgggggtccttcctgacaacgagggggtagccagaagagaagcactggattcctcagtccaccagctcagacagcacccaccggccccacccatcaagcccttttatattattttataaagtgacttttttattactttaattttttaaaaaaaggaaaataagaatatatgatgaatgatattgttttgtaactttttaaaaatgattttaaagagacaaaaaagaaaaaaaaaaaaaaaaaaaaaaaaaaaaa

SEQ ID NO: 8 - DNA, 3561 bp, homo sapiens
atggcattagtgctgtcggaatcctgataaaacatcacaaacttctgttcgttggtattagggacagtatagagtgagtgcttgaagaactgccttggcttaccaatctctctctccacaacttccaatcatctctagggaacctagcagaaacacttccacagagcaaaagttataatacagaaagtgatgaaaggaggacgcaggctctcaatgacgccaggtattcccgggacccgcccaccgtgggcgttttccacctacaggcaggcgtctccgggggcggggcttgctcagggttaacgtcactactgagcgccgggcgcgttccgttggcggcggattcgaacgttcggactgaggtttttctgcctgaagaagcgtcatacggaccggattgttttcgctggcccagtgtccccggagcttgtgtgcgatacagagagcacctcggaagctgaggcagctggtacttgacagagaggatggcgctgtcgaccatagtctcccagaggaagcagataaagcggaaggctccccgtggctttctaaagcgagtcttcaagcgaaagaagcctcaacttcgtctggagaaaagtggtgacttattggtccatctgaactgtttactgtttgttcatcgattagcagaagagtccaggacaaacgcttgtgcgagtaaatgtagagtcattaacaaggagcatgtactggccgcagcaaaggtatctgaaaactgaagagtggagaatatgttcagcagggaacaagaggattcttttagaaataagaggtagaaggtcacctcaaataccacaaaatgaatgggaagatgaacactatgcaagtactcattaaaaacatcccaaaatgctggaggaaatgccgtggaattaaggaatgactcttttgtggtagaaaatttttatttcagagtatagacactgcttgtgctgggtctcttaattttactggatattataattttcttggactgttagattttctcagtgcaacatttctgagagcaaatatgttctgctcaattaaatactttctaaagctagataaatgccttccagtaagcacattaacattcaatatgttatattttaccagaggtaaaacatttatattctaaaacattatattctaaaattttttaccccagggaaaataaaatgccaaaaatctcaactaccacacatagctttgtaataagatcaatgggcaaatggaatcagcttcagtttgcactaatcctacatatatgtattaaggatatgtgtaatgaactttggccataataaattataactaatttatttcatcagttcactactatatttctttcttgtttgcttctcctcttgtcgtctcttcatatttggtagaatatattttattgaatatctagtttcagattacctgagcttcagattacatggaattttggactgttgaatacttttgattgtgtagtggatataactaagcaattttttttttggggtgcatacttagaacgtaatttctggatcttttgataggcatattgttttagtttgttttctgcttctataacataatactgtagactgggtaatgtataaagaaaagagatttatttccctcagagttctggagattgtccaagatcaaggggctgcatctggtgaaatccttcttgctgtgtcctatatggtggaaagcatcacatggcaaggaagcatgcttgtgacagagagaatgagagctgaacttcatctttttatcagcaaccccctccagcaataattaacccaatcccacaataatggccttaatgtattcatgtgggcagagtccttataactcagtcacctcttgaaggtcccactcttaatgctgtcgcagtagcaattacatttcaacatgagttttggaagggatatttaaaccatagcatacatgtttgctataaaaacgccagttttccaagtgaatgtacccattttaaacacccaccagaatcatttgtgagatctaattgttcattcaatcttactatacttggtatggtcaattattttaattttagcaccataatgaatatgtagtgatattaaatttggtattactttgcattaatgactaaaaattagataacaaatgatattgaacttatttccacatgcttattgatcatttggatatattactttgtgaagttcctttttgaagccttttgcccatttttctttgtgttgtatttattttccatactcatcaaaaacatcccaaaatgctagaggaaatgctctagaattcaggaataacttcttttgtggtagagaatttttatttcagagtatagacactgtttgtgctgggtttcttaattttactggatatcatcattttcttgggctgtttgatcaagtttgattttcccagtgcaacatctctgagagtaaatatgatctgcttaataaaatatgttctaaagccagataagtgctttccagcaagtacaattttccttccagcaagtataatacctggtttataagcattacatatattaatattattattttgtcagatagatataataaaagtttaatatttcaatcttttatggtaagtgctatttatatactgtttaagaaagaggcacccatcatgacaataatgttctatattttcctatgaaagtcttgttttatatttcacatttaggttttgatggtccttaaatataagatttttatacatgatattatgtatggatttaggttaatttatttttatatggatagccaactaacccagaaccacttatcaaaaagacatcctttatacattgaattgcaatagtgttttatcaaaaccagctaagtatttttgagtgagtgtatttctgaactctctaatttgtttcatttgtttaccttttgttgtattatttcctcaccatcttaattatttttagccttataaaagctttgatatttggtagtataagttttcctgtttagtttttcttctgtaatattttcttgactatataaagtccttgcatttctatgtacattttagaataaaactgtcaatttgcacaaaataacaggctgggatttggatagagattatgttgatttgagggagattggcattttatcaatattgtgtctttcagtcaatatacagagtatatctatttagttattttgatattaatttttctcaccaatgttttatggtccttaaggaaaaagccttgcaatgtttctatatatgtgatcctaggtagtggacccttttagatgttattataaatgattttgctttttaattaaatttcatttttcagttatttctagtataaagaaatggaggtgactgattattggaaacatttatttgtaaattttcttatttttaatttttttgtagattcttgtaaattttctgcagaaaatttatatttttttctggctttattgaactgctttgaaactccagtgaaatgttgaataaaagtgctgataattgatattaaaaaaaaaaaaaaaaaaa

SEQ ID NO: 9 - DNA, 2628 bp, homo sapiens
ggcacgaggactagaaggaagaagtatggagttaaagactgcagcgtgaactgaggagtcccggacaggccgcttgctgcagaggatccagtccagatcccaggagagcccctctgccccttcggacctcgtctcccatctacaaaacgtgaagattggcccagttggcgtgtctctacaaaaaggtgcatataccactgccccgctgcaggctgatctgagaaagcctctggcccagggcagataccgccatggccttcctgatgcacctgctggtctgcgtcttcggaatgggctcctgggtgaccatcaatgggctctgggtagagctgcccctgctggtgatggagctgcccgagggctggtacctgccctcctacctcacggtggtcatccagctggccaacatcgggcccctcctggtcaccctgctccatcacttccggcccagctgcctttccgaagtgcccatcatcttcaccctgctgggcgtgggaaccgtcacctgcatcatctttgccttcctctggaatatgacctcctgggtgctggacggccaccacagcatcgctttcttggtcctcaccttcttcctggccctggtggactgcacctcttcagtgaccttcctgccgttcatgagccggctgcccacctactacctcaccaccttctttgtgggtgaaggactcagcggcctcttgcccgccctggtggctcttgcccagggctccggtctcactacctgcgtcaatgtcactgagatatcagacagcgtaccaagccctgtacccacgagggagactgacatcgcacagggagttcccagagctttggtgtccgccctccccggaatggaagcacccttgtcccacctggagagccgctaccttcccgcccacttctcacccctggtcttcttcctcctcctatccatcatgatggcctgctgcctcgtggcgttctttgtcctccagcgtcaacccaggtgctgggaggcttccgtggaagacctcctcaatgaccaggtcaccctccactccatccggctgcgggaagagaatgacttgggccctgcaggcatggtggacagcagccagggccaggggtatctagaggagaaagcagccccctgctgcccggcgcacctggccttcgtctataccctggtggccttcgtcaacgcgctcaccaacggcatgctgccctctgtgcagacctactcctgcctgtcctatgggccagttgcctaccacctggctgccaccctcagcattgtggccaaccctcttgcctcgttggtctccatgttcctgcctaacaggtctctgctgttcctgggggtcctctccgtgcttgggacctgctttgggggctacaacatggccatggcggtgatgagcccctgccccctcttgcagggccactggggtggggaagtcctcattgtggcctcgtgggtgcttttcagcggctgcctcagctacgtcaaggtgatgctgggcgtggtcctgcgcgacctcagccgcagcgccctcttgtggtgcggggcggcggtgcagctgggctcgctgctcggagcgctgctcatgttccctctggtcaacgtgctgcggctcttctcgtccgcggacttctgcaatctgcactgtccagcctaggcaggccgccgaccccgcccccatcgctcacggacggaactggggtccagagaggccaggtcacagagcaaggggcaggaacagagagacagagcctgagtaattgaatcatgaacgcaagtgcccactggggactgtggggaagatggcacctggaaatgcaaggtgcggctctatccccaactctgtgtcacactacctgtgacgaccagctcagatctcctttgctttgactctcaagagaggactgatttgcagcatctagctggaggcaggcccaagggtgttagaagggaaacagctgggacagccggctgtcccttcaggctgtgtgaccttgggaaagtcatttggcttctctgtgcctgtttcttcatgcatgcagtggggattccagtaagtaccaactacctcacaggcatggcacggaggcaaaaggaaaaagcagcccgcatcaagcaagccctcctgggccacctgctgatctgacagtccatcgtagtaacaagagtggcagtctgcacaacctagaagtggccagaagggttgagacacgcccctgccctctctcctttgcccctcagtctcacagaggggcttctacaagacaagcagataacgatagaatcttgggcatcttggctttcggattctcagtgtggagggacgtagtaccccacacaccccttcctgtcatccttcctggcccataaagcccactagttggagagtaagtaccctcctggaagcagggagagatgatttgctggtggggctggggaaggcccatccctgagcctctgaaagtgaactccccgaccaggttggggaccagacatgcagagcccctggaagtattctctcaaatggaggcaacagaggtgattgttattttgttttagtttctgtttttcatttttttaaataaaggcattccctgcttttaaaaaaaaaaaaaaaaaaaaaa

SEQ ID NO: 10 - DNA, 570 bp, homo sapiens
cgtacatacatagtctgatgacagttggtgggctgatttgaattatttctgtcttcattaccctttctgctgcggttgattctggtgtaatggggatatcatcagaccaagtcaggcttttgcccccacccaagaatgagaggaagttttgttatgatgtttctagctgtcgttcatccttccctgagacaatgaacaagtggaacaccttttaccagtatttgcagtcaccttttagtaagtttgatgatctgttgaagtacttatgggctgcacacacttcaaccttggcagataatatcaaaagttttgaagacagatatgattattattctaaagcagaagcgcattttgagagaagttgggtactggctgtggatcatttagctgcagtcctctttcctacaaccttgattagatcatataagttccagaagggcatgccaccacgaattcttcttaatactgatgtagcccctttcatcagtgactttactgcttttcagaatgtagtcctggttcttctaaatatgcttgacaatgtggataaatctataggttatctttgta

SEQ ID NO: 11 - DNA, 1704 bp, homo sapiens
gcctcaacctgacactcagcagcaagttaggcctatctacaaatctcctgctctgtgcccgcgcagtccagtggaggagatattcctaattagggggcacttccaaggggcggagtctccgcggcgagtggccgtggaggggcgcaaggcagacggtctccagccacgatacctgggccaatcccagcctgtcacgtcatgcctagtgagctgaacaagctgcgtaactgtcgtgtgcctcagtttccccacgtgtataatggaaatgattacaataaacaggacctttttgaggagttgccatgaggactgtcagacgccaaggcgccccgagaggcacttcgcttccatgccgaggccaagggcgcacaggtgcgtctggacacgcgtggctgcatcgcgcacaggcgcaccacgttccacgacggcatcgtgttcagccagcggccggtgcgcctgggcgagcgtgtggcgctgcgagtgctgcgggaggagagcggctggtgcggcggcctccgcgtgggcttcacgcgcctggaccccgcgtgcgtgtccgtgcccagcctgccgcccttcctgtgccccgacctggaggagcagagcccgacgtgggcggccgtgctgcctgagggctgcgcgctcactggggacttggtccgcttctgggtggaccgccgcggctgcctcttcgccaaggtcaacgccggctgccggctcctgctgcgtgagggcgtgcccgtcggcgccccgctctgggccgtgatggacgtgtatgggaccactaaggccatcgagctgctggatcccacagccagccggctcccaacacccatgccatgggacctcagcaacaaggctgtgcctgagcccaaagccacaccaggagaggagtgtgccatctgcttctatcacgctgccaacacccgccttgtgccctgcggccacacatacttctgcagatactgtgcctggcgggtcttcagcgatacggccaagtgccctgtgtgccgctggcagatagaggcggtagcccctgcgcagggccctcctgctctgagggttgaggaaggctcatgaaaggaggcttcccagtatgagtggcagcccgggcctagatctgagtctggcccctgcagagaggaaggaggcgcagccctaccttctttctggggaagagtcagaaaggctgattagcaagaggtgcggcagagagaggaaggcagggaggtgctgtctgctgcctccacctgttccccaacaggatagcaaggaaaaacccctctttctgtccatgccagaactatccttctgatggggtgctttgtttagagatggggtggcccaatccccaatcagttttacatctgagggagttcaggtatctgttgtgactggtgaagccctgtacctcctgggtattgaagaacctggacttgaagcaggaggtatctgcaaggaatgtataaagttccacatggaagctgggttgcctcccacaagtccccagtagagtggatctgtagttacccgccctgcctccctttcagggtggtcatgaggtcccagagagaccatgcatctgaagatgatttaaaacatgaaagtgtattgttgtcactgtggtaatttccttgccagtttctgagatatcaaaataaagtttgtgtttcctgaaaaaaaaaaaaaaaaaaaaaaaaaaaaaaa

SEQ ID NO: 12 - DNA, 1329 bp, homo sapiens
gggagctacaatgttttgtcattattcactctgatgtgaaaaaggcagtgaatttaatagaaaataacttcgtagagcaaaatctcaggtgtgtttttttagtgccgcagtcttggatgatgggttcctagaagctctcaacatctcttcttaattggagaaagtgttaagccccaaagtagctggagcagtacatcttcaatttttgacaagaaaacaggaacttgattactttgagtgctattcattagtttctgctttcattgagaatgcaacaaaagccaactaggctgctgctaactccttgctggacttcttctgccactgtcacaggaactgtaatctcactggacaattaactagggagtctttcatcttgagtgactgctgcacaaatgatcttcaaagcattttagccaccagaggaattctcttgaaatacccaaaatccatcagtatcttgaatcatgctggattttgaagaattcttaacaagccatgtaaagggggctctctggccttgaaatagtgatgttttttatacagaaaggagaatgcagaatggtcagactaccatgcactgttaaatttgatttcaagaaattacaggaaaactttccaaagttccatctcacagaaattatttttacaaagaattccaagataagtttagttttatggaagacttttatgtggtttttactcactcttcatctcagacatcaacagatgattacatcacttatttagctagtaaatttattaatataaaaactcagagacattccaatatccacattgcttacaccattaggcatagattcagtgtcagctatgacaattgaaaataagctgttttgtgatttaaaggtttaaatttctctaaccaaactgcttgatccagatgcaggactgcaaatgttaatatttgttctggaagaacaatcaaataagacttaagaggaaaaggaatggccacaatccacctgaaatttttttttaaaaagtgtgcagcctactaaatcagaatgaaaatagaagtacaagattataaacaaaatgcaatcaaacttttcttaagcttacctaaagttatttcatctgaaaatttcaagcaactttgttcaacattaaattgacaatctaaactaacaagtcttttgaatttatgcatggtagtaaacattctctctattaactgtattacctaaggctaaacctaaaatttttaagcaaaattagaaaaatagtcttcactcatcaaaaaataaagtttgttacatttagtattttcccaagaaaaaaaaaaaaaaaaaaaaaaaaaaaaaa

SEQ ID NO: 13 - DNA, 560 bp, homo sapiens
acaggtctttttatttaacataaggccaaagaagctatcaggcgttgctgaatactgtccactaactgtacaaaatattgactgcatgcctcgcaaacaccaaaatatccgctggaatgccatagaaataaataacttctgctataaacacatgaaaacatatcaaactgttatctctttaaacatattgtaaataaaaaaattaccagtacttctacacaataaatattaagaaaccattgacatagttgaaatgcactcatataaattaacaactttaattacattagccaaacagacattggttaaagaactgcatgtagtatgcaaaacaaaacaaaacaaaacaaaaaacaaagtaaaaaaccaacaaaatagaaacaaacaaacaaacaacatcaaccacagaacataaaaagttttaaaataaaacaggcttcagattatcttggctttcataattatatttttcttttaaagaaaaatatcaacccattgtcaatgcactgtttttcaaagcatttaaatagagggtaaaaccctttggaaattaatacaga

SEQ ID NO: 14 - DNA, 1805 bp, homo sapiens
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactcccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaaaaaaaaaaaaaaaaaa

SEQ ID NO: 15 - DNA, 3401 bp, homo sapiens
atggcttcgttccccgagaccgatttccagatctgcttgctgtgcaaggagatgtgcggctcgccggcgccgctctcctccaactcgtccgcgtcgtcgtcctcctcgcagacgtccacgtcgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttaacaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgccactcccgcaggcgccgcagccgcccgcgccttcccgctcggcacccggcggccctgccgcttccccgtcggcgctgctgctccgccgtcctcacggctgcagctcgtgcgatgagggcaacgcagcttcttcgcgctgcctcgactgccaggagcacctgtgcgacaactgcgtccgagcgcaccagcgcgtgcgcctcaccaaggaccactacatcgagcgcggcccgccgggtcccggtgccgcagcagcggcgcagcagctcgggctcgggccgccctttcccggcccgcccttctccatcctctcagtgtttcccgagcgcctcggcttctgccagcaccacgacgacgaggtgctgcacctgtactgtgacacttgctctgtacccatctgtcgtgagtgcacaatgggccggcatgggggccacagcttcatctacctccaggaggcactgcaggactcacgggcactcaccatccagctgctggcagatgcccagcagggacgacaggcaatccagctgagcatcgagcaggcccagacggtggcggaacaggtggagatgaaggcgaaggttgtgcagtcggaggtcaaagccgtgactgcgaggcataagaaagccctggaggaacgcgagtgtgagctgctgtggaaggtagaaaagatccgccaggtgaaagccaagtctctgtacctgcaggtggagaagctgcggcaaaacctcaacaagcttgagagcaccatcagtgccgtgcagcaggtcctggaggagggtagagcgctagacatcctactggcccgagaccggatgctggcccaggtgcaggagctgaagaccgtgcggagcctcctgcagccccaggaagacgaccgagtcatgttcacaccccccgatcaggcactgtaccttgccatcaagtcttttggctttgttagcagcggggcctttgccccactcaccaaggccacaggcgatggcctcaagcgtgccctccagggtaaggtggcctccttcacagtcattggttatgaccacgatggtgagccccgcctctcaggaggcgacctgatgtcggctgtggtcctgggccctgatggcaacctgtttggtgcagaggtgagtgatcagcagaatgggacatacgtggtgagttaccgaccccagctggagggtgagcacctggtatctgtgacactgtgcaaccagcacattgagaacagccctttcaaggtggtggtcaagtcaggccgcagctacgtgggcattgggctcccgggcctgagcttcggcagtgagggtgacagcgatggcaagctctgccgcccttggggtgtgagtgtagacaaggagggctacatcattgtcgccgaccgcagcaacaaccgcatccaggtgttcaagccctgcggcgccttccaccacaaattcggcaccctgggctcccggcctgggcagttcgaccgaccagccggcgtggcctgtgacgcctcacgcaggatcgtggtggctgacaaggacaatcatcgcatccagatcttcacgttcgagggccagttcctcctcaagtttggtgagaaaggaaccaagaatgggcagttcaactacccttgggatgtggcggtgaattctgagggcaagatcctggtctcagacacgaggaaccaccggatccagctgtttgggcctgatggtgtcttcctaaacaagtatggcttcgagggggctctctggaagcactttgactccccacggggtgtggccttcaaccatgagggccacttggtggtcactgacttcaacaaccaccggctcctggttattcaccccgactgccagtcggcacgctttctgggctcggagggcacaggcaatgggcagttcctgcgcccacaaggggtagctgtggaccaggaagggcgcatcattgtggcggattccaggaaccatcgggtacagatgtttgaatccaacggcagcttcctgtgcaagtttggtgctcaaggcagcggctttgggcagatggaccgcccttccggcatcgccatcacccccgacggaatgatcgttgtggtggactttggcaacaatcgaatcctcgtcttctaattgcatttcctaggtttctgtgtttggggtgtgtgtgcgtgtctctctctctctctctctctttctctttctctctctttttgaatttcaaagaagaaacagtctcagggaaatttcttttttcttttttttttttaaagagaacaagaaaagtacaacattgcttaagtcctacctcatctttatttttttacagatgaatgtacttatcttttctgcagggattgagcctgtgaagtgataatttctatctacctcataaatctttacatttccttctgcaacaggccctcttcccctcctcagtggagtttgcatttccctcttcccctgcgtggggcatgatatgcacaagcctggcatctgtatggctgggagggcactggatgtgtgtggtggggtgtattctgtagattgagccaaggaaacacaaaaaaaaactactaagtaaaaaaacaaaaaactataaaacatggaaaaaataggatttgaaatgcataattatagaatacctgtgttcttgagaatactgtttatatggggtttagattatgttgtgttgttttgatctttttggaaaatcttctctttttaaatgctgcaacagagaaatttcctctgttctctgtttatacctcttaattgtattgtccaaggcagacatgatataaggaatatgcactaccgtagtaactcccctggccgcagaaaccacactgcaagcctgtccggggtggggtgctgactgccatttgccacttttaaatgggcactgccgtggtaatgtgaatccc

SEQ ID NO: 16 - DNA, 474 bp, homo sapiens
  misc_feature (1)..(1): n is a, g, c or t
  misc_feature (3)..(3): n is a, g, c or t
  misc_feature (5)..(5): n is a, g, c or t
  misc_feature (416)..(416): n is a, g, c or t
  misc_feature (424)..(424): n is a, g, c or t
  misc_feature (463)..(463): n is a, g, c or t
  misc_feature (474)..(474): n is a, g, c or t
ntnantttgtcagtgaaaccatgtgtaagtttattagaaagttggattttttaacgacgaaaagagaaggacccacacaccttaattttgtacctataagcttgcgttctgtctgcataacatagatttagcccagtcttagccttctgcgtctaacactttcctaactattcattttaagtctataagcatgggttaaatgattacctcgtgcctgggccttgtgttgggggctctgaggaactctgcaatctttttattttcattttttgagacagggatcttgctctgtcacacagggctgggagtgcagtgggtaccatcacaggctcactacaggcctcaacctcgtggggctcaattgatccctcccacctcaggcctcttcaagtaggctgaggttacagggcacatgncaccatgncggggggtaattttttgtaggtttttgtaggagacaggntttcaccaagn

SEQ ID NO: 17 - DNA, 10434 bp, homo sapiens
atggcgaaccggcgagtggggcgaggctgctgggaagtgagcccgaccgagcggaggccgcccgcggggctgcggggccccgcggccgaggaggaggcgtcttccccgccggtcctgtctctcagccacttctgcaggtctcctttcctttgcttcggggacgttctcctgggagcctcacggacgctgtctctggccctagacaaccctaacgaggaggtggcagaagtgaagatctcccacttcccggccgcggacctgggcttcagtgtgtcgcagcgctgtttcgtgttgcagcctaaagagaaaattgttatttctgttaactggacaccactcaaagaaggccgagtaagagagattatgacatttcttgtaaatgatgttctgaaacaccaagctatattactaggaaatgcagaagagcagaaaaagaaaaagaggagtctttgggataccattaaaaagaagaaaatttcagcctctacaagtcacaacagaagggtttcaaatattcagaatgttaataaaacatttagtgtttcccaaaaagttgacagagttaggagcccactacaagcttgtgaaaacttggctatgaatgaaggcggtcccccaacagaaaacaattctttaatacttgaagaaaataaaatacccatatcacctattagccctgctttcaatgaatgccatggtgcaacttgcttgccactctctgtacgtcgatctactacctactcatctcttcatgcatcagaaaatagggaactattaaatgtacacagtgccaacgtttcaaaagtttcttttaatgagaaagctgtaactgaaacttcctttaattctgtaaatgttaatggccaaagaggagagaatagtaaacttagtcttacccccaactgttcttcaactttgaacattacacaaagccaaatacattttctaagtccagattcttttgtaaataatagtcatggagctaataatgaactagaattagtaacatgtctttcatcagatatgtttatgaaagataattcacagcctgtgcatttggaatcaacaattgcacatgaaatttatcagaaaattttaagtccagattctttcataaaagataattatggactaaatcaggatctagaatcagagtcagttaatcctattttatcccctaatcaatttttaaaagataacatggcatatatgtgtacatctcagcaaacatgtaaagtaccattatcaaatgaaaattctcaagtcccacagtctcctgaagattggagaaaaagtgaagtttcgccacgtattcctgaatgtcagggttcaaaatctcccaaagctatttttgaagaactagtagaaatgaagtcaaattactacagttttataaaacaaaataatcctaaattttctgcagttcaggatatttctagtcatagccacaataaacaacctaagagacgtccaatactttctgccactgttactaaaaggaaggccacctgtaccagagaaaaccaaactgagattaataaaccaaaagcaaaaagatgtctcaacagtgcagtgggtgaacatgaaaaagtaataaataatcaaaaggaaaaagaagattttcattcttatcttccaattatagatccaatattaagtaaatctaagagttataaaaacgaggtaacaccctcttcgacaacagcttcagttgctcggaaaagaaagagcgatggaagcatggaagatgcaaatgtgagagttgcaattacagaacatacagaagtgcgagaaatcaaaagaatccatttttctccctcagagcctaaaacatcagctgttaagaaaacaaaaaatgtgacaacacccatctcaaaacgtattagcaacagagagaaattaaacctgaagaagaaaactgatttatcaatattcagaactccaatttctaaaacaaacaaaaggacaaaacccattatcgctgtggcacagtccagtttgaccttcataaaaccattaaaaacagatattcccagacacccgatgccatttgctgcaaaaaacatgttttatgatgaacgctggaaggaaaagcaggaacagggcttcacttggtggttaaattttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatccttttggctttttcacgagatttcctaagtggtgaaggtgacctttcccgtcaccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccatttgacgctatatgtcagcgtactactcaaactgtggaatgtacgcaaactggttcagtggtattaaattcatcatctgaatctgatgacagttctctggatatgtcacttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcagggatattggagaagatattccactagacaaagatttctgaaattgaaatattattcaatcatcctgcaatctaggataagaatgataattgctgttacatcttataaacgatatctttgggctacagttacaattcagaggcattggcgtgcttatttaagaagaaaacaagatcaacaaagatatgaaatgctaaaatcatcaactcttataatccaatctatgttcagaaaatggaagcaacgtaaaatgcaatcacaagtaaaagctacagtaatattgcaaagagcttttagagaatggcatttaagaaaacaagctaaagaagaaaattctgctattatcatacaatcatggtatagaatgcataaagaattacggaagtatatttatattagatcttgtgttgttatcattcagaaaagatttcggtgctttcaagcccaaaagttatataaaagaagaaaagagtccatactaaccatccagaagtactacaaagcatatctgaaaggaaagattgagcgcaccaactatttgcagaaacgagctgcagccattcaattacaagctgcttttaggagactgaaagctcataatttatgtagacaaattagagctgcttgtgttattcagtcatactggagaatgagacaagacagagttcgatttttaaaccttaagaagactattatcaaatttcaggcacatgtaagaaaacatcaacaacgacagaaatataagaagatgaagaaagcagctgttataattcagactcatttccgagcttatatttttgccatgaaagttctagcatcttaccagaaaacacgctctgctgtcattgtgctgcagtctgcatatagagggatgcaagccaggaaaatgtatattcacatcctcacatctgttataaagattcaatcatattatcgtgcttatgtttctaaaaaggaatttttgagcctaaaaaatgctacaataaaattgcagtcaactgttaagatgaaacaaacacgtaaacaatatttgcatttaagagcagctgcactatttatccagcaatgttaccgttccaaaaaaatagctgcacaaaagagagaagagtatatgcagatgcgggaatcttgtatcaaactgcaagcatttgttagaggataccttgtccgaaagcagatgaggttacaaagaaaagctgttatttcactacagtcttatttcagaatgagaaaggctcggcagtattatctgaaaatgtataaagcaattattgtcattcagaattactatcatgcatacaaagcacaggtcaatcagaggaagaacttcttgcaagtcaaaaaagcagctacttgcttgcaagcagcttacagaggttataaagtacgccagctaatcaaacaacaatctatagctgctcttaaaattcagtctgcttttagaggctataataaaagggtaaaatatcaatctgtgcttcaatctataataaagattcagagatggtacagggcgtacaagactcttcatgatacaagaacacattttttgaagacaaaggcagctgtgatttccctccagtctgcttatcgtggctggaaggttcggaaacagattagaagggaacatcaagctgccttgaagattcagtctgcttttagaatggccaaggcccagaaacagtttagattgtttaaaacagcagcattagtcatccagcaaaatttcagagcatggactgcaggaaggaagcaatgtatggagtatattgaactccgtcatgcggtactggtgcttcaatctatgtggaagggaaaaacactgagaagacagcttcaaaggcaacataaatgtgctatcatcatacagtcatactatagaatgcatgtgcaacaaaagaagtggaaaatcatgaaaaaagctgctcttctgattcaaaagtattatagggcttacagtattggaagagaacagaatcatttatatttgaaaacaaaagcagctgtagtaactttacagtcagcttatcgtggtatgaaagtgagaaaaagaataaaggattgcaacaaagcagcagtcactatacagtctaaatacagagcttacaaaaccaaaaagaaatatgcaacctatagagcttcagctattataattcagagatggtatcgaggtattaaaattacaaaccatcagcataaggagtatcttaatttgaagaagacagcaattaaaatccaatctgtttatagaggtattagagttagaagacatattcaacacatgcacagggcagccacttttattaaagccatgtttaaaatgcatcagtcaagaataagttaccatacaatgagaaaagcagctattgttattcaagtaagatgtagagcatattatcaaggtaaaatgcagcgtgaaaagtacctgacaattttgaaagctgttaaagtccttcaggcaagttttagaggagtaagagttagacggactcttagaaagatgcagactgcagcaacactcattcagtcaaactacagaagatacagacagcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcgagctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgcacagaacatatattacatttcagacttggaaacatgcttcaattctaattcagcaacattatcgaacatatagagctgcaaaattgcaaagagaaaattatatcagacaatggcattctgctgtggttattcaggctgcatataaaggaatgaaagcaagacaacttttaagggaaaaacacaaagcttctatcgtaatacaaagcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccaccttagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattag

SEQ ID NO: 18 - DNA, 1925 bp, homo sapiens
agaccgcgcgcggggcgagcgagcggggcgcggcgaggggcaagggcggggagggccccggcgctcagagcaggcgccagggaggcaggctgggcggcccttcgtcctcgccttcgggtgtccatggccgcggtggccgtcctccggaacgactcgctgcaggcctttctccaggaccgcacccccagcgcctccccggacctgggcaagcactcgcccctggcattgctggccgccacctgtagccgcatcggccagccgggcgcggcggcgcccccggacttcctgcaggtgccctacgaccccgcgctgggctcaccctccaggctcttccacccgtggaccgccgacatgccggcgcactcgccaggcgcactgccgcccccgcatcccagcttggggctgacgccgcagaagacgcacctgcagccgtccttcggggctgcgcacgagcttccccttacaccccccgccgacccctcgtacccctacgagttctcgccggtcaagatgctgccctcgagcatggcggctctgcccgccagctgcgcgcccgcctacgtgccctacgcggcgcaggccgcgctgccgccaggctactccaacctgctgcctccgccgccgccaccgcccccgccgcccacctgccgccagttgtcacccaacccggcccccgacgacctcccgtggtggagcatcccgcaggcgggcgccgggccgggggcctccggggttccgggaagcggcctctccggcgcctgtgccggggccccccacgcgccccgcttccccgcctctgcggccgctgctgctgcggccgccgccgccctacaaagaggcctggtgttgggcccgtcggactttgcgcagtaccagagccagatcgccgcgctgctgcagaccaaggcccccctggcggccacggccaggaggtgccgccgctgccgctgtcccaactgccaggcggcgggcggcgcccccgaggcggagccggggaagaagaagcagcacgtgtgccacgtgccgggctgcggcaaggtgtacgggaagacgtcgcacctgaaggcgcacctgcgctggcacacgggcgagcgacccttcgtgtgcaactggctcttctgcgggaagagcttcacgcgctcggacgagctgcagcggcacctgcggactcacacgggcgagaagcgctttgcctgtcccgagtgcggcaagcgcttcatgcgcagcgaccacctcgcgaagcacgtcaagactcaccagaataagaagctcaaagtcgctgaggccggggttaagcgggaggacgcgcgggacctgtgagccctcccggaggtggacccccttcccagcacctctgcgagagatccggggacctgtgggcagctggcggaggggagactcagcagacggaccctctccgttgcctgcctcccaaaatggagccaggcttccaacttccgctgccttcggacatagggacccagttcccaggagcggggaggtagggttggggctggggcatttggattgtaattgggagctctgccgtacgccagggcggttccaaactctaaaccgttcccaccgtcagggagacctacagtttcgggggaccaccctggtctggccttgtatataggaaatgctgctgaactgaatagaaaggaacttgggagatttgaaacagtgctcgggttttcgctaggaccggtttgggctttgtacaggttatttaatagctttgttaaagataattataataattataacattaataaaaatgttgcttttgtcttcagctccatgcagagctacagcatgatatgtctctgtaaagtgatcagcagttgcagcgtgaaaataaatactttaactcaggggtcactacaggaagaccccgttgaaaaaaaaaaaaaaaaaaaaaa

SEQ ID NO: 19 - DNA, 1638 bp, homo sapiens
aagaattcggcacgagtgaaaatgtaagattatctgagtaatggacaatttctaatattcattttttaaagtagctaactctgccttattatccccttccacttttcccctggatgggtgatttatataatggaatgcagtgtcattgattgtgtttgaaggaggcacactaaatagcacactattgttatcttgaaaatttgttttattttgtttttgcccattttttaaatcatttcattctatttttgcccatgtctcttgtaatgagctacacatgtaattagtacacagagttctggtgatgtattcattcatgagtttaggaagtgagattttcagcttcatttccttctaagcatctcaactaggagcacaggggagacaaaaaagattgcaacctctttatacagttgtgtttgacccttggcactctattcttacttcaattatcgtccattgtaatgatcccttttcatgtctagcttaaccctaaactgtgagttccttgagaataagaactttgtcacagtgatgttttaatatattctcaccacacaataaaggatctaagtgtgtgctcaataaatgggtatttgttgggaaatttaaacaagaaatagtgaattattttctattcactatttggataccctttctccaaagatattttttatttgagagtatcttatttacagtaaaaatcacaaatattatatatacaatttagttttgacaaatgtctacatttctatcctttacccaggccttcaataagaaaataataataatttttttcccaaagacataatctggttatttggttatttggctgaaacaatgaatatctttgatacatggattctttaataatgaatctgttatttagtatttagtcattacttcataatgattccaaatttcctaataacttcttcccccactatccacccccatcccctgcccctgcaaaaaagacaaaacaaatctccctttccctcaggaagtagttgatttggtgcctgtgtaaggtagttcatgcatttccttcttctgttttgttaccataccgtatgcttggcactcagtacaccaagaaaacaaagaggcattgcctgtctcgaagttgcttagagtctagtgggggagataatgcacacctgcatccatagcacagcaatgtgtacataataacaaagatctgaaaaccccagtcagttttctatgttttgtcctctttcacacccttccgagagttctatctaatgtaactatgaatggtcactgtgtctttatttttggcccagactcttctcaatgcttcagcctcacgtatccaactacctactgattattctgcttggacatacatcagccattttaaatttggcctgagttgaactcattctctttctctcccacattcattgtgttttcatttgttttcttgaaatctcctggttaagtcagttcaggttgctatagaaaaaaattttgggtctggcgtggtgtcttgtgcctgtaatcccagaatgttgggaagcctaggtgggcagattgcttgagcctcaggagttcgagaccagccagggtgattatgaggaaactctgtctctgcaaaaaaaaaaaaaaaaaaaa

SEQ ID NO: 20 - DNA, 2706 bp, homo sapiens
ccgtgtgcagtcgccccgcgccccgcgcgacccttcgggtaaactacgaactgggagttctgaagaatgggtaaagactttcgttactatttccagcatccctggtctcgcatgattgtggcttacttggtgatcttctttaacttcttaatatttgcggaggacccagtttctcatagccaaacagaagccaatgttattgttgttggaaactgtttttcatttgttacaaataaataccctagaggagttggctggaggattttgaaggtgcttctatggctacttgccattctcacaggactaatagctggcaaatttctgttccatcagcgtttgtttggtcagttgctccgattaaaaatgtttcgagaagatcatgggtcgtggatgacaatgttcttcagcacaattctctttctcttcatattttctcacatatacaacacgattcttctaatggatgggaacatgggagcatatatcattacagactatatgggcatccgaaatgaaagtttcatgaaattagctgcagtagggacctggatgggggactttgtcacagcttggatggtcactgatatgatgcttcaggacaaaccctatcctgactggggaaaatcagcaagagctttctggaagaaaggaaatgttaggatcactttattctggacagttctttttactctgacgtctgtggttgtacttgtgattacaacggactggatcagctgggacaagctgaatcggggatttttgcccagtgatgaagtttccagagcattccttgcttcttttatcttggtctttgaccttcttattgtgatgcaggactgggaattcccacatttcatgggagatgttgatgtaaatctccctggtttgcacacccctcacatgcagttcaagattcctttcttccagaaaatcttcaaggaggaatatcgtattcacataacaggcaaatggtttaactatggaattatcttcctcgtcttgattttggatcttaatatgtggaagaaccaaatattttataaacctcatgaatatgggcaatatatcggcccggggcagaagatatatacagtgaaagactcagaaagtttaaaagatttgaacagaaccaagctatcctgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgacttctaaaagtacacctacgaactagactcggagatagacttggagataacacaaaaagcaaccttgagtgtaactttaaaaatttagtctttccttttgtatatgtaaggtttacgtagtgttaggtaaaaatatgaacaatgccacaacggtgctcaacatgctttttctaggattcattgttttctatttgtattataatacacgtgcctactgtatactcaacagtcctctagagattgcttttcacaattgcacaagctattactgactttacagcatagtggaagattagctgatgacccatgtatctgatgttcaaccatagtggtgccttgagacattaaactgtttttaactgtaccagaaatgaagtgtggaacagttacctaacctatttcacatgggcgttttgtatacaactattttgatctacacttgatgtctgagcagaaaacagaaatagctaaatgtgactcaggaagtatctcttggtttcttattcagcagcagagttggtgactttgacaactggactgcagagaaacatggtgatcaccttttaatttttattggctgtctgccaaatataaatacagatgcaaaattcagtaataggagatccataacccaacatgggtcactactcgtgaaatgtgactttctcccaccagtaattgaaatgaggtgatgatacctaattatgttttcctaattaaagataaattgctacttgattaaaaatcctgcccttcacctttgggaacaaaggttaagagacacagttgggcgaactctcaaatttattggcatttacacaaagtcccagacaaccaaggaactgaagttttcatcatatgagagcagcacatcccaccatttacaatattcgtatatctttctgcaaatatggctctggatagtgaaaattgaaaaacatatgccaaccctgagcaagggaactcctcaaaaaatcatgcagcggaaccttgtcaggtagagaagccgtgcatgaaagaatttgtttaatgtcttgttttgcgtatgtgttttttgtttttgttttttaagaactaaatattgcacattaataaataagaattatacagcaaaaaaaaaa

SEQ ID NO: 21 - DNA, 3110 bp, homo sapiens
tcgccggctgcggcgcctgggacggttgcggtgggtctgggcgctgggaagtcgtccaagatgattaaaaaattcgacaagaaggacgaggagtctggtagtggctccaatcctttccagcatctggagaagagtgctgttttacaggaggctcgtatattcaatgaaactccaatcaatccaagaagatgtttgcatattcttacaaagattctttacttactgaaccagggtgaacactttggaacaacggaagctacagaagccttctttgcaatgacgcgattgtttcaatctaatgatcaaacattgaggagaatgtgctaccttaccatcaaagaaatggctaccatctctgaggatgtgataattgtcacaagcagtctgactaaagacatgactggaaaagaagatgtataccgaggcccggccatcagagctctctgcaggatcaccgatggaacaatgttgcaagccattgaaagatacatgaagcaggccattgtggataaagtttccagtgtatccagttcagcactggtatcttccctgcacatgatgaagataagctatgatgtggttaagcgctggatcaatgaagcccaagaagctgcatcaagtgataatattatggtccagtaccatgcattgggagtcctgtatcaccttagaaagaatgatcgacttgctgtttccaagatgttgaataagtttactaaatctggtctcaagtcacagtttgcttactgcatgctgatccgaattgccagtcgcttactaaaagaaactgaggatggccatgaaagtccactgtttgatttcattgagagctgcttgcgaaataaacatgaaatggttatttatgaagctgcttcagctatcatccatcttcctaactgcactgcaagagagttggcacctgctgtttcagttcttcaacttttctgtagttctcctaagccagccttgagatatgcagctgtgaggaccttgaacaaggtggcaatgaagcacccctctgctgttactgcctgcaatctggacttagaaaacttaatcacagactcaaacagaagcattgctaccttagccattactacactcctcaaaacaggaagtgagagcagtgtggaccggctcatgaagcagatatcttcttttgtgtctgaaatctcagatgagttcaaggtggtggttgtacaggcaattagtgctctctgtcagaaataccctcgaaagcacagtgtcatgatgactttcctctccaacatgctccgagatgatggaggctttgagtacaagcgggccattgtggactgtataatcagcattgtggaagagaaccctgagagtaaagaagcaggcctagcccacctttgtgaattcattgaggactgtgaacacactgttctggctactaagattctacacttgttgggcaaagagggccctagaacgcctgtcccctccaaatatatccgttttatttttaatagggttgtcctggagaatgaggctgtcagagctgctgctgtgagtgctttggctaaatttggggctcagaatgagagtcttctcccaagcatccttgtactcttacagaggtgtatgatggatactgatgacgaggtacgagacagagctaccttctatctgaatgtgctgcagcagaggcagatggcactaaatgccacatatatctttaatggtttgacggtctctgtaccagggatggaaaaagccttacaccagtacacgttggagccttcagaaaaaccgtttgacatgaaatcaattcctcttgctatggctcctgtctttgaacagaaagcagaaatcacacttgtggctactaagccagagaagttggctccttccaggcaagacattttccaagaacaattggctgccattcctgagtttctgaatataggacccttgttcaagtcttctgagcctgttcaacttacagaagcagagacagaatattttgttcgatgtatcaagcacatgtttaccaatcacatcgtgttccagtttgactgcaccaacactctcaatgaccagctgctggaaaaagtgacagtgcagatggagccatcagattcctatgaagtgctgtcttgtatcccagcccccagccttccttataaccaaccaggaatatgttacactcttgttcgtttgcctgatgatgaccctacagcagttgcaggctcctttagctgcaccatgaagtttacagtccgggactgtgaccctaacactggagttccagatgaggatgggtatgatgatgagtatgtgctggaagatctcgaagtgactgtgtctgaccatattcagaaagtactgaagcctaactttgctgctgcttgggaagaggtgggagatacctttgagaaagaggaaacctttgccctcagttctaccaaaacccttgaagaggctgtcaacaatatcatcacatttctgggcatgcagccatgtgagaggtccgataaagtacctgagaacaagaattcccattcgctctatctggcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcaagcaaatgtctatctttgcgcatgggttgttttttttttttttctttttattctacttggtcagctttgggacgatagtgcagctttgggtgatcttgaaaatcaaatactatcctatactccagctgcttaacttcattttattctttaatgtgtacctgaaagctcctggcaatgctggaaaatttttatcccagaggggtgggggggaggggggaggggaagccagagtccacttttgtcacaattcatttttattaatagaaaataaacacttattccagtttc

SEQ ID NO: 22 - DNA, 1723 bp, homo sapiens
tagataaaagcaaagataatatttcattggttacagttatacagttacacagttatacagttgccttatttggtctatcccatgaggaagtcctagttactaattacgtttttgttggctgcttctgattggttgagcttaagttctgtgtttctttaacataggcatttacaagaaataccacaaataaagtttcagacatgcttgcaaatcaagcaaggttaaggtcacttaggaggcccaactggctctgtctgctcaaggattcttctggcctcgtctccattttacatgaactgttgcataaataaacacagagtacctgaaacaacggaggtgatcattctgcctaccgagtgttggccacgccaagcttggagtgttgctcttattcttagggagtttatttttaagtaatctcatctgtaaatgggattacaatccacaaactgaccttgtatatgattccattccttctcccagcccagccccacactccaaggttttccctttgcttataaggggtagtcacccttttttatttcgaccttccaaacattctgggagttttcctcctttaggccaactacagcgcagaggagcgctttctcctgctgggtttctccgactggccttccctgcagccggtcctcttcgcccttgtcctcctgtgctacctcctgaccttgacgggcaactcggcgctggtgctgctggcggtgcgcgacccgcgcctgcacacgcccatgtactacttcctctgccacctggccttggtagacgcgggcttcactactagcgtggtgccgccgctgctggccaacctgcgcggaccagcgctctggctgccgcgcagccactgcacggcccagctgtgcgcatcgctggctctgggttcggccgaatgcgtcctcctggcggtgatggctctggaccgcgcggccgcagtgtgccgcccgctgcgctatgcggggctcgtctccccgcgcctatgtcgcacgctggccagcgcctcctggctaagcggcctcaccaactcggttgcgcaaaccgcgctcctggctgagcggccgctgtgcgcgccccgcctgctggaccacttcatctgtgagctgccggcgttgctcaagctggcctgcggaggcgacggagacactaccgagaaccagatgttcgccgcccgcgtggtcatcctgctgctgccgtttgccgtcatcctggcctcctacggtgccgtggcccgagctgtctgttgcatgcggttcagcggaggccggaggagggcggtgggcacgtgtgggtcccacctgacagccgtctgcctgttctacggctcggccatctacacctacctgcagcccgcgcagcgctacaaccaggcacggggcaagttcgtatcgctcttctacaccgtggtcacacctgctctcaacccgctcatctacaccctcaggaataagaaagtgaagggggcagcgaggaggctgctgcggagtctggggagaggccaggctgggcagtgagtagttggggaggggagaaagtattaagccagaacccaaggatggaaataccccttagtgagtcagtttagacttcaggctgttcatttttgtatgataatctgcaagatttgtcctaaggagtccaatgggggatatgttttcctcccgtgaggaaatgtttagttcttgagggaaaaatccctaaatcctctatatac

SEQ ID NO: 23 - DNA, 545 bp, homo sapiens
tttaatagttagactcatactttattttgacaaatttaagatagaaaaatatcataatgtgaatatagcagttgctctttttgtaacatggtttgggatgtgcagtgaaacttgaaaggacttgctttacaggtggtccctcttctggctgggtttcagttaattctgaattatattccagccattgcatttgcttgaaagaatattggacacagtaaaaaaaagaacaggtttggcattcaataataaatattataaagcaatgaaccaaaacaacttttaaaataattactgaaagcaaacttcagacttcatgattaaagctaagaactcatattttcaaaatagctttaacagtttctatcaatatataatacaatagtaggacacttatttttaaaaaacaagtgagtagaatcagagtaaatatgatatttcagatgactataaacagtaaacatcaattcaatatatttatatatcatttcagcaatatactctgtgcccagctggcgataaaaactgtagttctatcatcaaaaaat

SEQ ID NO: 24 - DNA, 2880 bp, homo sapiens
tgctgctctccgcccgcgtccggctcgtggccccctacttcgggcaccatggacacctcccggctcggtgtgctcctgtccttgcctgtgctgctgcagctggcgaccgggggcagctctcccaggtctggtgtgttgctgaggggctgccccacacactgtcattgcgagcccgacggcaggatgttgctcagggtggactgctccgacctggggctctcggagctgccttccaacctcagcgtcttcacctcctacctagacctcagtatgaacaacatcagtcagctgctcccgaatcccctgcccagtctccgcttcctggaggagttacgtcttgcgggaaacgctctgacatacattcccaagggagcattcactggcctttacagtcttaaagttcttatgctgcagaataatcagctaagacacgtacccacagaagctctgcagaatttgcgaagccttcaatccctgcgtctggatgctaaccacatcagctatgtgcccccaagctgtttcagtggcctgcattccctgaggcacctgtggctggatgacaatgcgttaacagaaatccccgtccaggcttttagaagtttatcggcattgcaagccatgaccttggccctgaacaaaatacaccacataccagactatgcctttggaaacctctccagcttggtagttctacatctccataacaatagaatccactccctgggaaagaaatgctttgatgggctccacagcctagagactttagatttaaattacaataaccttgatgaattccccactgcaattaggacactctccaaccttaaagaactaggatttcatagcaacaatatcaggtcgatacctgagaaagcatttgtaggcaacccttctcttattacaatacatttctatgacaatcccatccaatttgttgggagatctgcttttcaacatttacctgaactaagaacactgactctgaatggtgcctcacaaataactgaatttcctgatttaactggaactgcaaacctggagagtctgactttaactggagcacagatctcatctcttcctcaaaccgtctgcaatcagttacctaatctccaagtgctagatctgtcttacaacctattagaagatttacccagtttttcagtctgccaaaagcttcagaaaattgacctaagacataatgaaatctacgaaattaaagttgacactttccagcagttgcttagcctccgatcgctgaatttggcttggaacaaaattgctattattcaccccaatgcattttccactttgccatccctaataaagctggacctatcgtccaacctcctgtcgtcttttcctataactgggttacatggtttaactcacttaaaattaacaggaaatcatgccttacagagcttgatatcatctgaaaactttccagaactcaaggttatagaaatgccttatgcttaccagtgctgtgcatttggagtgtgtgagaatgcctataagatttctaatcaatggaataaaggtgacaacagcagtatggacgaccttcataagaaagatgctggaatgtttcaggctcaagatgaacgtgaccttgaagatttcctgcttgactttgaggaagacctgaaagcccttcattcagtgcagtgttcaccttccccaggccccttcaaaccctgtgaacacctgcttgatggctggctgatcagaattggagtgtggaccatagcagttctggcacttacttgtaatgctttggtgacttcaacagttttcagatcccctctgtacatttcccccattaaactgttaattggggtcatcgcagcagtgaacatgctcacgggagtctccagtgccgtgctggctggtgtggatgcgttcacttttggcagctttgcacgacatggtgcctggtgggagaatggggttggttgccatgtcattggttttttgtccatttttgcttcagaatcatctgttttcctgcttactctggcagccctggagcgtgggttctctgtgaaatattctgcaaaatttgaaacgaaagctccattttctagcctgaaagtaatcattttgctctgtgccctgctggccttgaccatggccgcagttcccctgctgggtggcagcaagtatggcgcctcccctctctgcctgcctttgccttttggggagcccagcaccatgggctacatggtcgctctcatcttgctcaattccctttgcttcctcatgatgaccattgcctacaccaagctctactgcaatttggacaagggagacctggagaatatttgggactgctctatggtaaaacacattgccctgttgctcttcaccaactgcatcctaaactgccctgtggctttcttgtccttctcctctttaataaaccttacatttatcagtcctgaagtaattaagtttatccttctggtggtagtcccacttcctgcatgtctcaatccccttctctacatcttgttcaatcctcactttaaggaggatctggtgagcctgagaaagcaaacctacgtctggacaagatcaaaacacccaagcttgatgtcaattaactctgatgatgtcgaaaaacagtcctgtgactcaactcaagccttggtaacctttaccagctccagcatcacttatgacctgcctcccagttccgtgccatcaccagcttatccagtgactgagagctgccatctttcctctgtggcatttgtcccatgtctctaattaatatgtgaaggaaaatgttttcaaaggttgagaacctgaaaatgtgagattgagtatatcagagcagtaattaataagaagagctgaggtgaaactcggtttaaa

SEQ ID NO: 25 - DNA, 3789 bp, homo sapiens
ctctcagtaccacgccggtggccagttctgaggctagcaccctttcaacaactcctgttgacaccagcacacctgtgaccacttcttctccaaccaattcatctcctacaactgctgaagttaccagcatgccaacatcaactgctggtgaaggaagcactccattaacaaatatgcctgtcagcaccacaccggtggccagttctgaggctagcaccctttcaacaactcctgttgactccaacacttttgttaccagttctagtcaagccagttcatctccagcaactcttcaggtcaccactatgcgtatgtctactccaagtgaaggaagctcttcattaacaactatgctcctcagcagcacatatgtgaccagttctgaggctagcacaccttccactccttctgttgacagaagcacacctgtgaccacttctactcagagcaattctactcctacacctcctgaagttatcaccctgccaatgtcaactcctagtgaagtaagcactccattaaccattatgcctgtcagcaccacatcggtgaccatttctgaggctggcacagcttcaacacttcctgttgacaccagcacacctgtgatcacttctacccaagtcagttcatctcctgtgactcctgaaggtaccaccatgccaatctggacgcctagtgaaggaagcactccattaacaactatgcctgtcagcaccacacgtgtgaccagctctgagggtagcaccctttcaacaccttctgttgtcaccagcacacctgtgaccacttctactgaagccatttcatcttctgcaactcttgacagcaccaccatgtctgtgtcaatgcccatggaaataagcacccttgggaccactattcttgtcagtaccacacctgttacgaggtttcctgagagtagcaccccttccataccatctgtttacaccagcatgtctatgaccactgcctctgaaggcagttcatctcctacaactcttgaaggcaccaccaccatgcctatgtcaactacgagtgaaagaagcactttattgacaactgtcctcatcagccctatatctgtgatgagtccttctgaggccagcacactttcaacacctcctggtgataccagcacacctttgctcacctctaccaaagccggttcattctccatacctgctgaagtcactaccatacgtatttcaattaccagtgaaagaagcactccattaacaactctccttgtcagcaccacacttccaactagctttcctggggccagcatagcttcgacacctcctcttgacacaagcacaacttttaccccttctactgacactgcctcaactcccacaattcctgtagccaccaccatatctgtatcagtgatcacagaaggaagcacacctgggacaaccatttttattcccagcactcctgtcaccagttctactgctgatgtctttcctgcaacaactggtgctgtatctacccctgtgataacttccactgaactaaacacaccatcaacctccagtagtagtaccaccacatctttttcaactactaaggaatttacaacacccgcaatgactactgcagctcccctcacatatgtgaccatgtctactgcccccagcacacccagaacaaccagcagaggctgcactacttctgcatcaacgctttctgcaaccagtacacctcacacctctacttctgtcaccacccgtcctgtgaccccttcatcagaatccagcaggccgtcaacaattacttctcacaccatcccacctacatttcctcctgctcactccagtacacctccaacaacctctgcctcctccacgactgtgaaccctgaggctgtcaccaccatgaccaccaggacaaaacccagcacacggaccacttccttccccacggtgaccaccaccgctgtccccacgaatactacaattaagagcaaccccacctcaactcctactgtgccaagaaccacaacatgctttggagatgggtgccagaatacggcctctcgctgcaagaatggaggcacctgggatgggctcaagtgccagtgtcccaacctctattatggggagttgtgtgaggaggtggtcagcagcattgacatagggccaccggagactatctctgcccaaatggaactgactgtgacagtgaccagtgtgaagttcaccgaagagctaaaaaaccactcttcccaggaattccaggagttcaaacagacattcacggaacagatgaatattgtgtattccgggatccctgagtatgtcggggtgaacatcacaaagctacgtcttggcagtgtggtggtggagcatgacgtcctcctaagaaccaagtacacaccagaatacaagacagtattggacaatgccaccgaagtagtgaaagagaaaatcacaaaagtgaccacacagcaaataatgattaatgatatttgctcagacatgatgtgtttcaacaccactggcacccaagtgcaaaacattacggtgacccagtacgaccctgaagaggactgccggaagatggccaaggaatatggagactacttcgtagtggagtaccgggaccagaagccatactgcatcagcccctgtgagcctggcttcagtgtctccaagaactgtaacctcggcaagtgccagatgtctctaagtggacctcagtgcctctgcgtgaccacggaaactcactggtacagtggggagacctgtaaccagggcacccagaagagtctggtgtacggcctcgtgggggcaggggtcgtgctgatgctgatcatcctggtagctctcctgatgctcgttttccgctccaagagagaggtgaaacggcaaaagtacagattgtctcagttatacaagtggcaagaagaggacagtggaccagctcctgggaccttccaaaacattggctttgacatctgccaagatgatgattccatccacctggagtccatctatagtaatttccagccctccttgagacacatagaccctgaaacaaagagatccgaattcagaggcctcaggtaatgacgacatcattttaaggcatggagctgagaagtctgggagtgaggagatcccagtccggctaagcttggtggagcattttcccattgagagccttccatgggaactcaatgttcccattgtaagtacaggaaacaagccctgtacttaccaaggagaaagaggagagacagcagtgctgggagattctcaaatagaaacccgtggacgctccaatgggcttgtcatgatatcaggctaggctttcctgctcatttttcaaagacgctccagatttgagggtactctgactgcaacatctttcaccccattgatcgccaggattgatttggttgatctggctgagcaggcgggtgtccccgtcctccctcactgccccatatgtgtccctcctaaagctgcatgctcagttgaagaggacgagaggacgaccttctctgatagaggaggaccacgcttcagtcaaaggcatacaagtatctatctggacttccctgctagcacttccaaacaagctcagagatgttcctcccctcatctgcccgggttcagtaccatggacagcgccctcgacccgctgtttacaaccatgaccccttggacactggactgcatgcactttacatatcacaaaatgctctcataagaattattgcataccatcttcatgaaaaacacctgtatttaaatatagagcatttaccttttggta

SEQ ID NO: 26 - DNA, 4711 bp, homo sapiens
gccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattg

SEQ ID NO: 27 - DNA, 1853 bp, homo sapiens
ggcacgagggtccctgggccggacggcggtgtcccggcgtggcgggaagccggcactggagcgggagcgcactgggcgcgggaccgggaggcgcagggaccggacggctcccgagtcgcccacctgacgctagaagaagtcttcacttcccaggagagccaaagcgtgtctggccctaggtgggaaaagaactggctgtgacctttgccctgacctggaagggcccagccttgggctgaatggcagcacccacgcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaacctgggtctgctggtggtgaccctctggaggaggctggccccaggaaaggacgagcaggtccccatccgggtggtgcaggtgctgggcatggtgggcacagccctgctggcctctctgtggcaccatgtggccccagtggcaggacagttgcattctgtggccttcttagcactggcctttgtgctggcactggcatgctgtgcctcgaatgtcactttcctgcccttcttgagccacctgccacctcgcttcttacggtcattcttcctgggtcaaggcctgagtgccctgctgccctgcgtgctggccctagtgcagggtgtgggccgcctcgagtgcccgccagcccccatcaacggcacccctggccccccgctcgacttccttgagcgttttcccgccagcaccttcttctgggcactgactgcccttctggtcgcttcagctgctgccttccagggtcttctgctgctgttgccgccaccaccatctgtacccacaggggagttaggatcaggcctccaggtgggagccccaggagcagaggaagaggtggaagagtcctcaccactgcaagagccaccaagccaggcagcaggcaccacccctggtccagaccctaaggcctatcagcttctatcagcccgcagtgcctgcctgctgggcctgttggccgccaccaacgcgctgaccaatggcgtgctgcctgccgtgcagagcttttcctgcttaccctacgggcgtctggcctaccacctggctgtggtgctgggcagtgctgccaatcccctggcctgcttcctggccatgggtgtgctgtgcaggtccttggcagggctgggcggcctctctctgctgggcgtgttctgtgggggctacctgatggcgctggcagtcctgagcccctgcccgcccctggtgggcacctcggcgggggtggtcctcgtggtgctgtcgtgggtgctgtgtcttggcgtgttctcctacgtgaaggtggcagccagctccctgctgcatggcgggggccggccggcattgctggcagccggcgtggccatccaggtgggctctctgctcggcgctgttgctatgttccccccgaccagcatctatcacgtgttccacagcagaaaggactgtgcagacccctgtgactcctgagcctgggcaggtggggaccccgctccccaacacctgtctttccctcaatgctgccaccatgcctgagtgcctgcagcccaggaggcccgcacaccggtacactcgtggacacctacacactccataggagatcctggctttccagggtgggcaagggcaaggagcaggcttggagccagggaccagtgggggctgtagggtaagcccctgagcctgggacctacatgtggtttgcgtaataaaacatttgtatttaaaaaaaaaaaaaaaaaaaaa

SEQ ID NO: 28 - DNA, 2564 bp, homo sapiens
actgttccgcgggcaccggcagcgcagcgtctccgatagtaagtcgggctgccggccggctcattcccccagggtaactctgagcccccggctccgagctccctcgaggccgcctaccggcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtaccagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaattttctttagttttaattgaaaatgtttgcttttaaaactgataggtattgttggaaagcaggatgaagcctgagccagtggaaaagcttgttacagaaaaaacattttgtgttattgctgtggtgtgcatgatttgcaaagattaagtgcattttctctgtctatactgattattgtatatagaggatgttataaatatacatatacatttttgccattatgtaaatcccatgatttcaactgtaaacatctgtccattggtgtagctttacaaaccattcactgattttgtgtaatttaacaatagatatgaaataaagtttaaattac

SEQ ID NO: 29 - DNA, 2733 bp, homo sapiens
gctttctaaggcggtcgctccgggaaatccgggccctaggattgtccactcatcccagtatcagcgagatacggggagatagagttagcgacaacgtgagccagagctggagcacgtttggtgagagaccagaaagcaatggaggccggagaggggaaggagcgcgttccgaaacaaaggcaagtcctgatattctttgttttgctgggcatagctcaggctagttgccagcctaggcactattcagtggccgaggaaacggagagtggctcctttgtggccaatttgttaaaagacctggggctggagataggagaacttgctgtgaggggggccagggtcgtttccaaaggaaaaaaaatgcatttgcagttcgataggcagaccggggatttgttgttaaatgagaaattggaccgggaggagctgtgcggccccacagagccctgtgtcctacctttccaggtgttactagaaaatcccttgcagttttttcaggcggagctacggattagggacgtaaatgatcattccccagttttcctagacaaagaaatacttttgaaaattccagaaagtatcactcctggaactactttcttaatagaacgtgcccaggacttggatgtaggaaccaacagtctccaaaattacacaatcagtcccaatttccactttcatcttaatttacaagacagtctcgatggcataatattaccacagctggtgctgaacagagccctggatcgcgaggagcagcctgagatcaggttaaccctcacagcgctagatggcgggagtccacccaggtccggcacggccctggtacggattgaagttgtggacatcaatgacaacgtcccagagtttgcaaagctgctctatgaggtgcagatcccggaggacagccccgttggatcccaggttgccatcgtctctgccagggatttagacattggaactaatggagaaatatcttatgcattttcccaagcatctgaagacattcgcaaaacgtttcgattaagtgcaaaatcgggagaactgcttttaagacagaaactggatttcgaatccatccagacatacacagtaaatattcaggcgacagatggtgggggcctatctggaacttgtgtggtatttgtccaagtgatggatttgaatgacaatcctccggaactaactatgtcgacacttatcaatcagatcccagaaaacttgcaggacaccctcattgctgtattcagcgtttcagatcctgactccggagacaacggaaggatggtgtgctccatccaagatgatcttccttttttcttgaaaccttctgttgagaacttttacactctggtgataagcacggccctggaccgggagaccagatccgaatacaacatcaccatcaccgtcaccgacttcgggacacccaggctgaaaaccgagcacaacataaccgtgctggtctccgacgtcaatgacaacgcccccgccttcacccaaacctcctacaccctgttcgtccgcgagaacaacagccccgccctgcacatcggcagcgtcagcgccacagacagagactcgggcaccaacgcccaggtcacctactcgctgctgccgccccaggacccgcacctgcccctcgcctccctggtctccatcaacgcggacaacggccacctgttcgctctccagtcgctggactacgaggccctgcaggcgttcgagttccgcgtgggcgccgcagaccgcggctccccggcgttgagcagcgaggcgctggtgcgcgtgctggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggcgtgtgggcgcacaatggcgaggtgcgcaccgccaggctgctgagggagcgcgacgctgccaagcagaggctggtggtgctggtcaaggacaatggcgagcctccgcgctcggccaccgccacgctgcacgtgctcctggtggacggcttctcccagccctacctgctgctcccggaggcggcaccggcccaggcccaggccgacttgctcaccgtctacctggtggtggcgttggcctcggtgtcttcgctcttcctcttctcggtgctcctgttcgtggcggtgcggctgtgcaggaggagcagggcggcctcggtgggtcgctgctcggtgcccgagggcccctttccagggcagatggtggacgtgagcggcaccgggaccctgtcccagagctaccagtacgaggtgtgtctgactggaggctccgggacaaatgagttcaagttcctgaagccaattatccccaacttcgttgctcagggtgcagagagggttagcgaggcaaatcccagtttcaggaagagctttgaattcacttaagtgttaataaggatctactgaggctagtctcgtttaatttgtggaaagtccttttttactgctttgcccattggaggtgtctccttttattagaaagtaaccatcttattccaattctatgcatgttactggtatttataaatgtatgagtttttttgcggtataataaatgtaaattttctttgtattctaaaaaaa

SEQ ID NO: 30 - DNA, 1007 bp, homo sapiens
cggaagcgcgacgctggagctgcggggttaccatgggaaccgaaccgccgcgcctcgcccaggacagttacacttagaggccttcatcatcatgatgttaagctgcctctttcttctgaaggcacttcttgctcttgggtctctggaatcctggataactgcaggagaacatgcaaaagagggagaatgccctccccataagaacccatgcaaagagctgtgccagggtgatgaattgtgtccggctgaacagaagtgctgcaccacaggctgtggtcggatctgccgagacattcctaaggggaggaaaagagattgccctagggttattcggaaacaatcctgtttgaaaaggtgcatcactgatgagacatgtccaggtgtaaagaaatgctgcacgcttggctgcaacaagagctgtgtagtcccaatctctaaacagaagctggcagagtttggtggtgaatgtcccgctgacccccttccgtgtgaggagctgtgtgatggggatgcatcctgtccccaggggcataaatgctgcagcaccggctgtggccgcacctgcctcggagacattgagggagggcggggcggtgattgtccaaaagttctggtgggcctgtgcattgttggctgtgtgatggatgagaattgtcaagctggagaaaaatgttgcaagtcaggctgtggccgcttctgtgtcccaccagtcctgcccccaaaactgaccatgaaccccaactggactgtgaggtctgattccgaattagagatcccggtgccctagctgtgctgatttgtctggagcttctttggtaattctggaagcttttcctggcagtcaagagagggtgacatcctggggcttgtgacatttccaggggcactcatggccctctctgctctgcttctcctcctgccgctgaccagagcatgggaaatagccctggattgggtagtgggtgtgtggtgcttctctttcccgataaaggctggtgctgacctct

SEQ ID NO: 31 - DNA, 4720 bp, homo sapiens
gcgagacctagcaggcccggggctgggcgtgccctcgcctgccacgctgcgcgctgccctcagccgggccgctggggccgtgcagtgcaccgggcacgccgcgccaggctgggggcaggcaccgagcctccgtgggaggtcccgaggcagcttcgcctgctcgccctggctccagccctcacctgccgcagccttagctgagcagccgccgccactgggcgccccccgctccccacttcgccagcgcccgctcctcggctcggcccggggtagtttgtagggacgcagctctccacgtgcgcgactgcgaggctggacgctacgggctcctggaaaggagacaccagcatttgccacaatgctgtcatccactgactttacatttgcttcctgggagcttgtggtccgcgttgaccatcccaatgaagagcagcagaaagacgtcacactgagagtatctggagaccttcatgttggaggagtgatgctcaagttagtagaacagatcaatatatcccaagactggtcagactttgctctttggtgggaacagaagcattgctggcttctgaaaacccactggaccctggacaaatatggggtccaggcagatgcaaagcttctcttcacccctcagcataaaatgctgcgccttcgtctgccgaatttgaagatggtgaggttgcgagtcagcttctcagctgtggtttttaaagctgtcagtgatatctgcaaaatcctgaatattagaagatcagaagagctttccttgttaaagccgtctggtgactattttaagaagaagaagaaaaaagacaaaaataataaggaacccataattgaagatattctaaacctggagagttctccaacagcttcaggttcatcagtaagtcctggtttatacagtaaaaccatgacccctatatatgaccccatcaatggaacaccagcatcatccaccatgacttggttcagtgacagccctttgacggaacaaaactgcagcatcctcgcattcagccaacccccccagtccccagaagcacttgcggatatgtaccagcctcggtctctggttgataaagccaagctcaatgcaggttggctagactcctcacgctcccttatggaacaaggcatccaagaggatgagcagctgctcttacgatttaaatattattctttcttcgacttgaatcctaaatatgatgctgtccgaataaaccaactctatgagcaagccaggtgggccattctcttagaagaaattgattgcacagaggaagaaatgttgatctttgcagctctacagtaccacattagcaaactgtcgttgtctgctgaaacacaggattttgcaggcgagtccgaggttgatgaaatagaagcggcgctttctaatttggaagtaaccctagaaggtggaaaagcggacagccttttggaggacattactgatatccctaaacttgcagataatctcaaattatttaggcccaagaagttactaccaaaagctttcaaacaatattggtttatctttaaagacacatccatagcatactttaaaaataaggaacttgaacaaggagaaccactagaaaaactaaatcttagaggctgcgaagttgtgcccgatgtaaatgtagcaggaagaaaatttggaatcaagttactaatccctgttgccgatggtatgaatgaaatgtatttgagatgtgaccatgagaatcaatacgcccaatggatggctgcctgcatgttggcatcgaagggcaaaaccatggcagacagctcctaccagccagaggtcctcaacatcctttcatttctgaggatgaaaaacaggaactctgcatctcaggtggcttccagtctcgaaaacatggatatgaacccagaatgttttgtgtcaccacggtgtgcaaagaaacacaaatccaaacagctggccgcccggatcctggaggcgcaccagaacgtggcccagatgcccctggtcgaagccaagctgcggttcatccaggcgtggcagtcactgcctgagtttggcctcacctactaccttgtcagatttaaaggaagcaaaaaagatgacattctgggagtttcatataacaggttgattaaaattgatgcagccaccgggattccagtgacaacatggagattcacaaatatcaaacagtggaatgtaaactgggaaacccggcaggtggtcatcgagtttgaccaaaacgtctttactgctttcacctgcctgagtgcagattgcaagattgtgcacgagtacattggcggctacattttcttgtccacccgctccaaggaccagaatgaaacactcgatgaggacttgttccacaaattgaccggcggtcaggattgaaacaagcacgcgtgctcggctcacaccaacaaggcaagccaaaggcgcccctccccagagggatccctaacgtgcccagcatgtagattctggactaacagacaacatacattcaccgctggtcacccagatcctcattcaaacccactgctggcacatccctttccttactttgccctgtgctaccagccacggaaggagcctctcttgttttttctataaaatgggtaggcaggagaaaagcaggtgccctaagattgctctaaggcccagcatgtggttacagttctctgacttgcagaacctgccaggtgtatggctacaagttatcctcgtgctgatctgtctcattactaagtcaatggagaagacagaaaggtaaaaatcacgtgtagcaagaacaactcttatttcacaaactcaggtatgaaacgaaacgcctgtccttcatggaactgcttttagctcctgtcttttcaaaatggcagagggagttcctacacacactttttccctggaggccaaggtctaggggtagaaaggggaggggtggggctaccaggtagcagttgacaacccaaggtcagaggagtggccctcagtgtcatctgtccacagtgatacctgccaagatgaccactgacccacatctggtcttagtcattggtctcctcagatttctggggccacctgcaagccccattccattcctacagatctctcagccacctgtaagtcctttgtgaagatgtgggtgacacagggggacaggaaaacccatttctcaacccagatccatgtctccactgcttctactctgggttgggattcaggaagacaggcacagtcctctctgttcatagaaacacctgccagtgtcaaggattccagtcaggtgtctatcccaactggtcagggagagaagggcagacccattctcaaagaccaccatgtccaaggtctgacagctccccactggctgcccccacaggggctttaggctggtctgggtcatggggaagcgtccctcttatcgctggtctgtgttctcctggatttggtatctatgttggtacgactcctggccttttatctaaaggactttggcttttgtaaatcacaagccaataatagacttttttctccccctctgttttttgctgtgtcatctctgccttgagactgccttgagacagtgcttgccttgagagagtgagccaattaacagctgcctgaattgtcattttccattttggtttgttagaggtgggaggggtgggttttgagaaggtcaaaagcaataccagaagtaaagggaaatatcagacaatattttattattttttcatagatgttctgccacacaaagaacttggggtgtaaggataaggcaaaagctccaatcccatttttcagttctcctaggatgcacccctcagggagcctggccagagttccgaggctcgtgagcgtcagctgttgctttattttccatcaaagccctctgagaagtgagacctcagcaattccgggagccacatagagacagacttggcaagggaccccctggttctgagccagtagctgccatctggaaattcctcttttagcctctccttagaggtgaatgtgaatgaagcctcccaggcacccgctgaatttctgaggccttgcttaaagctcagaagtggtttaggcatttggaaaatctggttcacatcataaagaacttgatttgaaatgttttctatagaaacaagtgctaagtgtaccgtattatacttgatgttggtcatttctcagtcctatttctcagttctattattttagaacctagtcagttctttaagattataactggtcctacattaaaataatgcttctcgatgtcagattttacctgtttgctgctgagaacatctctgcctaatttaccaaagccagaccttcagttcaacatgcttccttagcttttcatagttgtctgacatttccatgaaaacaaaggaaccaactttgttttaaccaaactttgtttggttacagttttcaggggagcgtttcttccatgacacacagcaacatcccaaagaaataaacaagtgtgacaaaaaaaaaaaaaaacaaacctaaatgctactgttccaaagagcaacttgatggttttttttaatactgagtgcaaaaggtcacccaaattcctatgatgaaattttaaattaatgggcacctttcaacatcatttgcttccttatctacagttgattcagaaatctgcattttttattcttttatatgacttttaagtaaaagatttatatggatttg

SEQ ID NO: 32 - DNA, 4266 bp, homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtaaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaggctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttttgtagagacagggtttcgccatgttgacgagactggtctcgaactcctggcctcaagtgatctgccgcctcagcttctcaaagtactgggattatataggcatgagccactgagcctggccctgaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgcc

SEQ ID NO: 33 - DNA, 2618 bp, homo sapiens
atgaagcacctgaagcggtggtggtcggccggcggcggcctcctgcacctcaccctcctgctgagcttggcggggctccgcgtagacctagatctttacctgctgctgccgccgcccaccctgctgcaggacgagctgctgttcctgggcggcccggccagctccgcctacgcgctcagccccttctcggcctcgggagggtgggggcgcgcgggccacttgcaccccaagggccgggagctggaccctgccgcgccgcccgagggccagctgctccgggaggtgcgcgcgctcggggtccccttcgtccctcgcaccagcgtggatgcatggctggtgcacagcgtggctgccgggagcgcggacgaggcccacgggctgctcggcgccgccgccgcctcgtccaccggaggagccggcgccagcgtggacggcggcagccaggctgtgcaggggggcggcggggacccccgagcggctcggagtggccccttggacgccggggaagaggagaaggcacccgcggaaccgacggctcaggtgccggacgctggcggatgtgcgagcgaggagaatggggtactaagagaaaagcacgaagctgtggatcatagttcccagcatgaggaaaatgaagaaagggtgtcagcccagaaggagaactcacttcagcagaatgatgatgatgaaaacaaaatagcagagaaacctgactgggaggcagaaaagaccactgaatctagaaatgagagacatctgaatgggacagatacttctttctctctggaagacttattccagttgctttcatcacagcctgaaaattcactggagggcatctcattgggagatattcctcttccaggcagtatcagtgatggcatgaattcttcagcacattatcatgtaaacttcagccaggctataagtcaggatgtgaatcttcatgaggccatcttgctttgtcccaacaatacatttagaagagatccaacagcaaggacttcacagtcacaagaaccatttctgcagttaaattctcataccaccaatcctgagcaaacccttcctggaactaatttgacaggatttctttcaccggttgacaatcatatgaggaatctaacaagccaagacctactgtatgaccttgacataaatatatttgatgagataaacttaatgtcattggccacagaagacaactttgatccaatcgatgtttctcagctttttgatgaaccagattctgattctggcctttctttagattcaagtcacaataatacctctgtcatcaagtctaattcctctcactctgtgtgtgatgaaggtgctataggttattgcactgaccatgaatctagttcccatcatgacttagaaggtgctgtaggtggctactacccagaacccagtaagctttgtcacttggatcaaagtgattctgatttccatggagatcttacatttcaacacgtatttcataaccacacttaccacttacagccaactgcaccagaatctacttctgaaccttttccgtggcctgggaagtcacagaagataaggagtagataccttgaagacacagatagaaacttgagccgtgatgaacagcgtgctaaagctttgcatatccctttttctgtagatgaaattgtcggcatgcctgttgattctttcaatagcatgttaagtagatattatctgacagacctacaagtctcacttatccgtgacatcagacgaagagggaaaaataaagttgctgcgcagaactgtcgtaaacgcaaattggacataattttgaatttagaagatgatgtatgtaacttgcaagcaaagaaggaaactcttaagagagagcaagcacaatgtaacaaagctattaacataatgaaacagaaactgcatgacctttatcatgatatttttagtagattaagagatgaccaaggtaggccagtcaatcccaaccactatgctctccagtgtacccatgatggaagtatcttgatagtacccaaagaactggtggcctcaggccacaaaaaggaaacccaaaagggaaagagaaagtgagaagaaactgaagatggactctattatgtgaagtagtaatgttcagaaactgattatttggatcagaaaccattgaaactgcttcaagaattgtatctttaagtactgctacttgaataactcagttaacgctgttttgaagcttacatggacaaatgtttaggacttcaagatcacacttgtgggcaatctgggggagccacaacttttcatgaagtgcattgtatacaaaattcatagttatgtccaaagaataggttaacatgaaaacccagtaagactttccatcttggcagccatcctttttaagagtaagttggttacttcaaaaagagcaaacactggggatcaaattattttaagaggtatttcagttttaaatgcaaaatagccttattttcatttagtttgttagcactatagtgagcttttcaaacactattttaatctttatatttaacttataaattttgctttctatggaaataaattttgtatttgtattaaaaattaacttttcccttttatacaga

SEQ ID NO: 34 - DNA, 799 bp, homo sapiens
gtgcaatggctagtactatgtgtcaacttgtctaggctatactgctcagctgtgtggtcaaacagtagtctagatgttgctgtgaaggtattttgtagatgtgatcaacatttacaatcagttgattttaagtaaagcagtttaacttccaatatgtggatgggcctcatccaattagttgaaggtgttaagagaaaagaccaaggtttcctggaaaaggaattctaccacaagactaacataaaaatgcactgtgagtttcatgcctgctggcctgccttcactgtcctgggggaggcttggagagaccaggtggactggagtatactgttgagagacgctggtctggtgaagatgtccaggaaaccacgagcctccagcccattgtccaacaaccacccaccaacaccaaagaggttcccaagacaactcggaagggaaaagggacccatcgaggaagttccaggaacaaaaggctctccataaaagaccgccgcttcaaaaaaacctgaggaatggagtgggccaacactatccagccactctgaccagccgaacgaggaactcaatcaaaatgagccatagcgggaccacaagggcaaggagaccaccactttctccagtctcttttcggacagccagtaattcccgggcaaggccagagacttcaagtctatctgaaaagtctccagaggtctaaccccagataaatagccaacagggtgtagagtacgttttacaccccaaagggtatgccccatgtgagggaaataaaatgaacatgttgtaaaaaaaaaaa

SEQ ID NO: 35 - DNA, 2050 bp, homo sapiens
tctagaggatccgccaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaagaagagacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacacgactccatcacagggagcctgaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgaattcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaaaaaaaaaaaaaaaaaaaaaaaa

SEQ ID NO: 36 - DNA, 1537 bp, homo sapiens
agttctgtggagcagcggtggccggctaggatgggctctctggggtctgactctgccccttttcttcttctgctgggagggtggggtctctaggagctctgcaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccagggaagccatctttgacaccctttgcaccgatgacatctctgaagaggcaaagacactcacaatggacatattgacattggctcacacctccacagaagctaagggcctgtcctcagagagcagcgcctcttccgacggcccccatccagtcatcaccccgtcacgggcctcagagagcagcgcctcttccgacggcctccatccagtcatcaccccgtcacgggcctcagagagcagcgcctcttccgacggcctccatccagtcatcaccccgtcacgggcctcagagagcagcgcctcttccgacggcccccatccagtcatcaccccctcatggtccccgggatctgacgtcactctcctcgctgaagccctggtgactgtcacaaacatcgaggttattaattgcagcatcacagaaatagaaacaacgacttccagcatccctggggcctcagacacagatctcatccccacggaaggggtgaaggcctcgtccacctccgatccaccagctctgcctgactccactaacacaaaaccacacatcactgaggtcacagcctctgccgagaccctgtccacagccggcaccacagagtcagctgcacctgatgccacgattgggaccccactccccaccaacagcaccatagaaagagaagtgacagcacccggggccacgaccctcagtggagctctggccacagggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagccccttggaagccgccctcaagaacttcaccccttcagagacactgaccacggacatcgcaaccaaggggcccttccccaccagcagggcccctcttccttctgtccctccgactacaaccaacagcagctgaaggacgaacagcatcttagccaagaccacaacctcagcgaagaccacgatgaagcccccaacagccacgcccaccactgctcggacgaggccgaccacagacatgagtgcaggt

SEQ ID NO: 37 - DNA, 777 bp, homo sapiens
ggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattc

SEQ ID NO: 38 - DNA, 4231 bp, homo sapiens
ggaaaagagggcacccagcccttccccctccctcatcctcccatcccagtaaaccctgccaaattggaatcctggacttaatttaggagaaaggccctgtaaccaagatactgactgaacatggctggcggactcaggctggggtctgcagtgcagcattaatgggccgctgacatgaatatggagtagttttctctagcaaagagtggcttccagcttcttaaagtctgacaagaaccggatagggggaacctacaagaagaccatctataaagaatacaaggatgactcatacacagatgaagtggcccagcctgcctggttgggcttcctggggccagtgttgcaggctgaagtgggggatgtcattcttattcacctgaagaattttgccactcgtccctataccatccaccctcatggtgtcttctacgagaaggactctgaaggttccctatacccagatggctcctctgggccactgaaagctgatgactctgttcccccggggggcagccatatctacaactggaccattccagaaggccatgcacccaccgatgctgacccagcgtgcctcacctggatctaccattctcatgtagatgctccacgagacattgcaactggcctaattgggcctctcatcacctgtaaaagaggagccctggatgggaactcccctcctcaacgccaggatgtagaccatgatttcttcctcctcttcagtgtggtagatgagaacctcagctggcatctcaatgagaacattgccacttactgctcagatcctgcttcagtggacaaagaagatgagacatttcaggagagcaataggatgcatgcaatcaatggctttgtttttgggaatttacctgagctgaacatgtgtgcacagaaacgtgtggcctggcacttgtttggcatgggcaatgaaattgatgtccacacagcatttttccatggacagatgctgactacccgtggacaccacactgatgtggctaacatctttccagccacctttgtgactgctgagatggtgccctgggaacctggtacctggttaattagctgccaagtgaacagtcactttcgagatggcatgcaggcactctacaaggtcaagtcttgctccatggcccctcctgtggacctgctcacaggcaaagttcgacagtacttcattgaggcccatgagattcaatgggactatggcccgatggggcatgatgggagtactgggaagaatttgagagagccaggcagtatctcagataagtttttccagaagagctccagccgaattgggggcacttactggaaagtgcgatatgaagcctttcaagatgagacattccaagagaagatgcatttggaggaagataggcatcttggaatcctggggccagtgatccgggctgaggtgggtgacaccattcaggtggtcttctacaaccgtgcctcccagccattcagcatgcagccccatggggtcttttatgagaaagactatgaaggcactgtgtacaatgatggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcagaaaggggtggataaagaattctttcttctcttcactgtgttggatgagaacaagagctggtacagcaatgccaatcaagcagctgctatgttggatttccgactgctttcagaggatattgagggcttccaagactccaatcggatgcatgccattaatgggtttctgttctctaacctgcccaggctggacatgtgcaagggtgacacagtggcctggcacctgctcggcctgggcacagagactgatgtgcatggagtcatgttccagggcaacactgtgcagcttcagggcatgaggaagggtgcagctatgctctttcctcatacctttgtcatggccatcatgcagcctgacaaccttgggacatttgagatttattgccaggcaggcagccatcgagaagcagggatgagggcaatctataatgtctcccagtgtcctggccaccaagccacccctcgccaacgctaccaagctgcaagaatctactatatcatggcagaagaagtagagtgggactattgccctgaccggagctgggaacgggaatggcacaaccagtctgagaaggacagttatggttacattttcctgagcaacaaggatgggctcctgggttccagatacaagaaagctgtattcagggaatacactgatggtacattcaggatccctcggccaaggactggaccagaagaacacttgggaatcttgggtccacttatcaaaggtgaagttggtgatatcctgactgtggtattcaagaataatgccagccgcccctactctgtgcatgctcatggagtgctagaatctactactgtctggccactggctgctgagcctggtgaggtggtcacttatcagtggaacatcccagagaggtctggccctgggcccaatgactctgcttgtgtttcctggatctattattctgcagtggatcccatcaaggacatgtatagtggcctggtggggcccttggctatctgccaaaagggcatcctggagccccatggaggacggagtgacatggatcgggaatttgcattgttgttcttgatttttgatgaaaataagtcttggtatttggaggaaaatgtggcaacccatgggtcccaggatccaggcagtattaacctacaggatgaaactttcttggagagcaataaaatgcatgcaatcaatgggaaactctatgccaaccttaggggtcttaccatgtaccaaggagaacgagtggcctggtacatgctggccatgggccaagatgtggatctacacaccatccactttcatgcagagagcttcctctatcggaatggcgagaactaccgggcagatgtggtggatctgttcccagggacttttgaggttgtggagatggtggccagcaaccctgggacatggctgatgcactgccatgtgactgaccatgtccatgctggcatggagaccctcttcactgttttttctcgaacagaacacttaagccctctcaccgtcatcaccaaagagactgaaaaagcagtgccccccagagacattgaagaaggcaatgtgaagatgctgggcatgcagatccccataaagaatgttgagatgctggcctctgttttggttgccattagtgtcacccttctgctcgttgttctggctcttggtggagtggtttggtaccaacatcgacagagaaagctacgacgcaataggaggtccatcctggatgacagcttcaagcttctgtctttcaaacagtaacatctggagcctggagatatcctcaggaagcacatctgtagtgcactcccagcaggccatggactagtcactaaccccacactcaaaggggcatgggtggtggagaagcagaaggagcaatcaagcttatctggatatttctttctttatttattttacatggaaataatatgatttcactttttctttagtttctttgctctacgtgggcacctggcactaagggagtaccttattatcctacatcgcaaatttcaacagctacattatatttccttctgacacttggaaggtattgaaatttctagaaatgtatccttctcacaaagtagagaccaagagaaaaactcattgattgggtttctacttctttcaaggactcaggaaatttcactttgaactgaggccaagtgagctgttaagataacccacacttaaactaaaggctaagaatataggcttgatgggaaattgaaggtaggctgagtattgggaatccaaattgaattttgattctccttggcagtgaactactttgaagaagtggtcaatgggttgttgctgccatgagcatgtacaacctctggagctagaagctcctcaggaaagccagttctccaagttcttaacctgtggcactgaaaggaatgttgagttacctcttcatgttttagacagcaaaccctatccattaaagtacttgttagaacactgaaa

SEQ ID NO: 39 - DNA, 6322 bp, homo sapiens
ctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaactctacattgagtttgtcaaggggtactatgacaatcccaaggtctgtgcactctacatcatggctgggacagtggatgatgtaccaaagcttcagcctcatccgggattggagaagaaagaagaggaagaagaagaagaagaatatgatgaagggtctaatctcaaaaaacagaccaataagaaccgggtgcagtcaggcccccgcacacccaacccctatgcctcggacaacagcagcctcatgtttcccatcctggtggccttcggagtcttcattccaaccctcttctgcctctgccggttgtgagaacaaatgactatcctgaacagggtggaggggtgtgggaaagaaaccagccatattggttttggtttctgtatttttcacaatgattaatgaacaaaaacaaagagaaaaaaaacacacatcaattaaaggagacaaaaagaggcagagcgagtagagagcagccctcattcaccacctggtcccagacgtgcttcagtcctcgtcctctctttgtggctggctcccagccttctctttcctcttgaggatacttagggtaaactggatccttcctgctcaaggatcctcatttgtatacctagtggaaaggactctgaactcagaggagtcactgttcctttttttaggttagaaattaacagcagggaaatgccatcttattacctgagacgaccagcactgggagttaggtacggtctgaagttatgtctagataagacttcagacgtcctgggattgaaagaatgtgtgtgaaggggtagaatttgtgcggtaaagacttaaaaaaaaaagtagggagattaaaaaaaaagaaagaaaatgcttccttatctggaagcctttctggattaatccagtgatggtcccacctttagtgtttgagctttgtcattgcttgtctccctggcatgtgccagttatagactgtccagcatccaagacgtttcggttatgtcgggtcctcagatcgcctctgacttgttaccacaacaaatcattttgatttcagtgcctgttggggacttgatttcttctcaggttttgtttgtttgtttgtttccttaatctggctcatttgaaatttcttctccctctcaaccatcccactaagttatagccaagaagggaaggagacacggggatttggggttctctgcttgaatgtcttctcctttaccacctcaccttgttggtacctccctccctggatctctgagccagcagccaggaggacctgacccagcagttctttactggcccctttgtagggccttgctgccagggggcagggatgctttccagcctgcagcaacagaacacttgaccttaaaagtctcttctggtctttggattagaaaaggcttatgttagcatagcttaagagcaacctcagagacttgagccctactaagtgactgaccactgtttagagtgtctggtatctgatgttcatttattcccatgttcttgtgtgtcacagttcagccagttttggtttatgcctagagctacttcaaggaactagactaattagctatataggcccagcgatgcttcttattgatcttaatagtatgcccttccttcccctgtcctttcatttctctatccaagtagcagtcaggttcttggtgtgatgggactgaaagaattccagtcagccagagccttggcagctctgaagctaaccttagcatctaagtgtcgatcttgaattccctgaaaaaatttctataggaaatgaagcttccctggtcccctcctttctggccattgtcatccatttcccagttagggcaacaatgaaggaggacccagccaagctagaaggaattttgtggatgggagacagcaggattagcttcagcttgggctggagcagtcaatataggatctcaggccaggcccgcttttctagaatgtgtttaattttgagtttgctttattagatatgttttttaagagctctgtatatttgaactgctccttatgtgacaaaataggtagctcttgggctcatgtcctgggttttggctctttaatgattactccaggccagcatttagtcgtttgagaattgtagcctgttgttttcgctgtgacttgggtctcagtgctagggtattgagtcaggcagctggagggttgtggcccgaggctgcagtcagaggtatacttcccatagtgcttcacacagctcccctgcttctaaaggataaggtactgtagccttggtcctggggaccacctgcctggggcagtggacatcctaactaaacaggcttctggcagtagctttggttcctatcccatcgaaattccccaaagccctgggccactgccattgggttagtcaagatgaaggaggaggactggctgcctccattttgccttgtttgttagtttgcctgggtctgtctgaggaaggagggggtcccgccttccacctcaacacatcccttcagtgactcagagtctcagaaggaaaccctgactcctggggccatttcctaatggtactgtaagccaagcagctttgcttctgcctctgtttccaagcccacccttttcccctgagctcagggttagggatgggcgctttcctctctggttgtgaacgaaaggaaggaacatctttctatggctaacaaaaactaaaggggaagtgaggaaacaggaagaagtatggtgggggctggggtagactcccctggagccaagcctatccagctaacaagagctccctggggctggtcacagctggctcatgatgctgaacttgaaagtttttttgtttttgtttttgttttgtggctcctccaagatataggtacatgaagtttaggttaaaggggtgggattctttatttttatttttgtattgtatgtgtcaagaattactctgttgttcaccttttgctttttgcactgtttgttctcttatctgtattttgagcttagtgctaggactgagaggctgcaccatagggaatgtatgggagatggtgaggggtgccagtgaggggtgcgtggaggagaggcctgggctcctctactggatctacactctgtcccaggtttttagatcccactgagcccagctgactgaaaacaaggacagtcagggtgaaacttcttttgccagaagtgtggcctgagttgaatttctgggaggatgacgcagatgtctgctgcagagctgggctgagagttctgcagtctagctctgacttaggtcaggggcctgttggtctctcattggacgtttttgggtctcactcatgcttactgaaacattgtgccaagaaactctgtgggatttgtgtcccttaaaccagactcacttttctgaaaaatctccattgttgaggagaggctgctcaatcgacaccccgagttctcatgactgggaagatagttttcttcaggtgtcaatggcgttagactcccaggaagactagccctgcccacagggccacctgttggtttgagagcgtgttcgtgttctcttgccctccctgcctaagagctactgggatcacgttagcgggcatttaggctttgatgagagggcacagtttgagttaggtttacctccccctttctgtgcctgggaactgtttggtccagctttagaactgtggttttgacttccttatctcttgggagaagcttctgttttaaggaatttctcttccttcttctcctgcctctagcctctcctggaaaggcctggatatggtttctaaaatctcagctgagaacttcagaaaacagcagcagtattttccttttcctagtgctaaaatccctttccctagaaattggctcaccttgggaaacccagggaaagaatcagcaggttctctgccctccctaggggttggggaaggacccaccccggtcagcacagtgccttttcctctcctgctctgagccagggtggggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacactgaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggtaggaaaagagcaggatggatctcttgggacaggttcccccaggagtataaacacaaggagccaggattgtcctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttccctggtgtgttgtgatccagggaatgaaaagaaatttgaccctggattggttctctccttggacttaaggaatcttaccttttccttccacaaagttctcccaggcaaggaccagctgcccattctgagcccagggcagcctcttcaaccattattggtctaacctggcttgtcaggaaaccaagcccacccttccacattgggcctggctgctctattctgtaccaagtactggagaaaaagcatcaagttcttagcccttgtagcttctaccctagtttcccatcctctctctgtggaggccaaaccaactctttgccagcagccacaacatgcattgacagcggcacagtgagatataactgatgggctttgaacctggttggccggggaagctgtaggggtggatagagctggctttccttctgggctgtctccatctgaccctaccccttccatgtcccaccccactcccaccaaaaagtacaaaatcaggatgtttttcactgtccattgctttgtgttttaataaacaatttgcagtgac

SEQ ID NO: 40 - DNA, 3600 bp, homo sapiens
gaatcaacagaatttgtctttttgtgactggtttatttcacttaacttcatcctcaaggttcaacttaaaggtgtatccatgttgtagcacgtgtcagcattttctttcgttctcaggctaaatagtatttcattgtgtgtgtacaccatgtttcatgcattcattcatcccttgaaagattggtgggttgtttcctcctttttgcttttgtgaacagtgctacgaacatggttgtacaaacatctcttggagccccactagcagttcctttgggtatataccccaaagtggaattgctggatctggtagctccctttttaattttttgaggaatcgccacacagtttccataacagctgcaccattttacattcccaagaccttttttttttttttttttttaagaagaaaagatgtgtttctgcatttctggaagtctatgctgcatttccatttgttgaaatttaagaccagagtcatcttttctgctgtaattataatggtcactggcttgtgccttttcctcctctctctgccccatctgcacggggtctttgaacaagtcccagcaccttggtggacaagcctgtgtccctggcccatcatggaagccgctgcctttcagagtgggagtctgtaccctgttgcctcattccttgctgcgcccatgagtgagcttgtgcctgacctctccttccaggtggacttacacactgggctgtcggagttctcggtgacgcagcgccggctggcccatggctggaatgagtttgttgctgacaacagcgaacctgtgtggaagaaatacctggatcagtttaagaaccccctgatcctgctgctgctgggctctgccctggtgagtgtcctcaccaaggagtatgaggacgccgtcagcatcgccacggcagtgcttgtcgtggtcactgtcgccttcatccaggagtacaggtcggagaaatctctggaagagctgaccaagctggttcctccagaatgtaactgcctaagagaaggaaaactccagcacctgcttgctcgagaactggttcctggtgatgtcgtatctctctcgatcggagaccggatccctgcagacatccgactcactgaggtcacggacctcttggtggatgaatccagtttcaccggggaagccgagccatgtagtaaaacagacagccccttgacaggcggtggggacctcaccaccctcagcaacatcgtcttcatggggaccctggtgcagtatgggaggggccagggggtcgtgattggaacaggggaaagctctcagttcggagaagtgtttaagatgatgcaggctgaagagacacctaaaactcctttgcagaaaagcatggacaggctaggaaagcaactgacactcttctcctttggcataatcggtctcatcatgctcattggctggtcgcaagggaaacaactcctgagtatgttcacgatcggggtcagcctggctgtggcggctattccagagggtctgcccatcgtcgtcatggtgacgctggtcctgggagtgctgcggatggccaagaagcgggtcatcgtgaagaagttacccatcgtggagactttaggttgctgcagcgttctctgttctgacaagacggggactctgactgccaatgaaatgacagtgacccagcttgtaacgtcagatgggcttcgtgccgaggtcagcggagttgggtatgacggtcaagggactgtgtgtcttctaccatccaaggaagtcattaaggaattttccaatgtctcagtgggaaagttagtggaggcgggctgtgttgccaacaatgcggtcatcagaaagaacgccgtgatggggcagcccaccgagggtgcattgatggccctggcgatgaagatggacttaagtgatattaaaaattcatatataagaaaaaaagagattccattcagttcagagcagaagtggatggcggtgaaatgcagtctgaagactgaggatcaggaagacatttacttcatgaaaggggccttggaagaggtgatccgctactgcaccatgtacaacaacgggggcatccccctgccgctgacgccccagcagaggtcattctgcctgcaggaagagaagaggatggggtcgctcggtttgcgggtgctggccctggcttctgggcccgagctggggcggctgacgtttctaggtcttgtgggcatcattgaccccccgagagttggcgtgaaggaagcagtccaggttctctccgagtctggtgtgtctgtgaagatgataacgggggatgccctggagacggccttggccataggaagaaacatcggcctgtgcaacgggaagctgcaagccatgtccggggaggaggtggacagcgtggagaagggcgagctggccgaccgcgtggggaaggtgtccgtgttcttcaggaccagcccaaagcacaagctcaaaatcatcaaggctctgcaggagtcaggggcgatcgtggccatgactggggatggggtgaacgacgcagtggccctgaagtctgcagacattgggatcgccatggggcagacagggacggacgtcagcaaagaggccgccaacatgatcctggtggatgatgacttctcagccatcatgaatgcagtggaggaaggcaagggtattttttacaacatcaaaaactttgtccgattccagctgagcacgagcatctccgccctgagtctcatcactctgtccaccgtgttcaacctgcccagccccctcaacgccatgcagatcctatggatcaacatcatcatggatgggccaccggcgcagagcttgggggtagagcccgttgacaaagacgccttcaggcagccaccacggagtgtgcgggacaccatcctcagcagagccctcatcctgaagatcctcatgtccgcggccatcatcatcagcgggaccctctttatcttctggaaggagatgcctgaagacagagcaagcactccccgcaccacgacgatgacgttcacttgttttgtgtttttcgatctcttcaacgccttgacctgccgctctcagaccaagctgatatttgagatcggctttctcaggaaccacatgttcctctactccgtcctggggtccatcctggggcagctggcggtcatttacatccccccgctgcagagggtcttccagacggagaacctgggagcgcttgatttgctgtttttaactggattggcctcatccgtcttcattttgtcagagctcctcaaactatgtgaaaaatactgttgcagccccaagagagtccagatgcaccctgaagatgtgtagtggaccgcactccgcggcaccttccctaatcatctcgatctggttgtgactgtggcccctgccgtgtctcctcgtcaggggagacttttaggaggccgcagccttccatcaccggatcagtttttcctcttaggaaagctgcaggaacctcgtgggctccagggacccaggcccacatccatccagcgttcccgctggctgtgggacagacagggaggggcctgtacagaaacaccacactgtttattaaatcacaatgatttttatt

SEQ ID NO: 41 - DNA, 2507 bp, homo sapiens
cagcacaccccggcacctcctctgcggcagctgcgcctcgcaagcgcagtgccgcagcgcacgccggagtggctgtagctgcccggcgcggcgccgccctgcgcgggctgtgggctgcgggctgcgcccccgctgctggccagctctgcacggctgcgggctctgcggcgcccggtgctctgcaacgctgcggcgggcggcatgggataacgcggccatggtgcgccgagatcgcctccgcaggatgagggagtggtgggtccaggtggggctgctggccgtgcccctgcttgctgcgtacctgcacatcccaccccctcagctctcccctgcccttcactcatggaagtcttcaggcaagtttttcacttacaagggactgcgtatcttctaccaagactctgtgggtgtggttggaagtccagagatagttgtgcttttacacggttttccaacatccagctacgactggtacaagatttgggaaggtctgaccttgaggtttcatcgggtgattgcccttgatttcttaggctttggcttcagtgacaaaccgagaccacatcactattccatatttgagcaggccagcatcgtggaagcgcttttgcggcatctggggctccagaaccgcaggatcaaccttctttctcatgactatggagatattgttgctcaggagcttctctacaggtacaagcagaatcgatctggtcggcttaccataaagagtctctgtctgtcaaatggaggtatctttcctgagactcaccgtccactccttctccaaaagctactcaaagatggaggtgtgctgtcacccatcctcacacgactgatgaacttctttgtattctctcgaggtctcaccccagtctttgggccgtatactcggccctctgagagtgagctgtgggacatgtgggcagggatccgcaacaatgacgggaacttagtcattgacagtctcttacagtacatcaatcagaggaagaagttcagaaggcgctgggtgggagctcttgcctctgtaactatccccattcattttatctatgggccattggatcctgtaaatccctatccagagtttttggagctgtacaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatacctttggatttagtgtttcatcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaaaaaaaaaaaaaaaaaaaaaaaaaaaaaaaaaaaaaaaaaaaaaaaa

SEQ ID NO: 42 - DNA, 3560 bp, homo sapiens
gagctagcgctcaagcagagcccagcgcggtgctatcggacagagcctggcgagcgcaagcggcgcggggagccagcggggctgagcgcggccagggtctgaacccagatttcccagactagctaccactccgcttgcccacgccccgggagctcgcggcgcctggcggtcagcgaccagacgtccggggccgctgcgctcctggcccgcgaggcgtgacactgtctcggctacagacccagagggagcacactgccaggatgggagctgctgggaggcaggacttcctcttcaaggccatgctgaccatcagctggctcactctgacctgcttccctggggccacatccacagtggctgctgggtgccctgaccagagccctgagttgcaaccctggaaccctggccatgaccaagaccaccatgtgcatatcggccagggcaagacactgctgctcacctcttctgccacggtctattccatccacatctcagagggaggcaagctggtcattaaagaccacgacgagccgattgttttgcgaacccggcacatcctgattgacaacggaggagagctgcatgctgggagtgccctctgccctttccagggcaatttcaccatcattttgtatggaagggctgatgaaggtattcagccggatccttactatggtctgaagtacattggggttggtaaaggaggcgctcttgagttgcatggacagaaaaagctctcctggacatttctgaacaagacccttcacccaggtggcatggcagaaggaggctatttttttgaaaggagctggggccaccgtggagttattgttcatgtcatcgaccccaaatcaggcacagtcatccattctgaccggtttgacacctatagatccaagaaagagagtgaacgtctggtccagtatttgaacgcggtgcccgatggcaggatcctttctgttgcagtgaatgatgaaggttctcgaaatctggatgacatggccaggaaggcgatgaccaaattgggaagcaaacacttcctgcaccttggatttagacacccttggagttttctaactgtgaaaggaaatccatcatcttcagtggaagaccatattgaatatcatggacatcgaggctctgctgctgcccgggtattcaaattgttccagacagagcatggcgaatatttcaatgtttctttgtccagtgagtgggttcaagacgtggagtggacggagtggttcgatcatgataaagtatctcagactaaaggtggggagaaaatttcagacctctggaaagctcacccaggaaaaatatgcaatcgtcccattgatatacaggccactacaatggatggagttaacctcagcaccgaggttgtctacaaaaaaggccaggattataggtttgcttgctacgaccggggcagagcctgccggagctaccgtgtacggttcctctgtgggaagcctgtgaggcccaaactcacagtcaccattgacaccaatgtgaacagcaccattctgaacttggaggataatgtacagtcatggaaacctggagataccctggtcattgccagtactgattactccatgtaccaggcagaagagttccaggtgcttccctgcagatcctgcgcccccaaccaggtcaaagtggcagggaaaccaatgtacctgcacatcggggaggagatagacggcgtggacatgcgggcggaggttgggcttctgagccggaacatcatagtgatgggggagatggaggacaaatgctacccctacagaaaccacatctgcaatttctttgacttcgatacctttgggggccacatcaagtttgctctgggatttaaggcagcacacttggagggcacggagctgaagcatatgggacagcagctggtgggtcagtacccgattcacttccacctggccggtgatgtagacgaaaggggaggttatgacccacccacatacatcagggacctctccatccatcatacattctctcgctgcgtcacagtccatggctccaatggcttgttgatcaaggacgttgtgggctataactctttgggccactgcttcttcacggaagatgggccggaggaacgcaacacttttgaccactgtcttggcctccttgtcaagtctggaaccctcctcccctcggaccgtgacagcaagatgtgcaagatgatcacagaggactcctacccggggtacatccccaagcccaggcaagactgcaatgctgtgtccaccttctggatggccaatcccaacaacaacctcatcaactgtgccgctgcaggatctgaggaaactggattttggtttatttttcaccacgtaccaacgggcccctccgtgggaatgtactccccaggttattcagagcacattccactgggaaaattctataacaaccgagcacattccaactaccgggctggcatgatcatagacaacggagtcaaaaccaccgaggcctctgccaaggacaagcggccgttcctctcaatcatctctgccagatacagccctcaccaggacgccgacccgctgaagccccgggagccggccatcatcagacacttcattgcctacaagaaccaggaccacggggcctggctgcgcggcggggatgtgtggctggacagctgccggtttgctgacaatggcattggcctgaccctggccagtggtggaaccttcccgtatgacgacggctccaagcaagagataaagaacagcttgtttgttggcgagagtggcaacgtggggacggaaatgatggacaataggatctggggccctggcggcttggaccatagcggaaggaccctccctataggccagaattttccaattagaggaattcagttatatgatggccccatcaacatccaaaactgcactttccgaaagtttgtggccctggagggccggcacaccagcgccctggccttccgcctgaataatgcctggcagagctgcccccataacaacgtgaccggcattgcctttgaggacgttccgattacttccagagtgttcttcggagagcctgggccctggttcaaccagctggacatggatggggataagacatctgtgttccatgacgtcgacggctccgtgtccgagtaccctggctcctacctcacgaagaatgacaactggcattcgttggcttcaaaggcagcttccggcccatctgggtgacactggacactgaggatcacaaagccaaaatcttccaagttgtgcccatccctgtggtgaagaagaagaagttgtgaggacagctgccgcccggtgccacctcgtggtagactatgacggtgactcttggcagcagaccagtgggggatggctgggtcccccagcccctgccagcagctgcctgggaaggccgtgtttcagccctgatgggccaagggaaggctatcagagaccctggtgctgccacctgcccctactcaagtgtctacctggagcccctggggcggtgctggccaatgctggaaacattcactttcctgc

SEQ ID NO: 43 - DNA, 2340 bp, homo sapiens
gatagcgccgggcagagggacccggctaccctggacagcgcatcgccgcccgcccgggtcgccgcgccacagccgctgcggatcatggaacatctaaaggcctttgatgatgaaatcaatgcttttttggacaatatgtttggaccgcgagattctcgagtcagagggtggttcacgttggactcttaccttcctaccttttttcttactgtcatgtatctgctctcaatatggctgggtaacaagtatatgaagaacagacctgctctttctctcaggggtatcctcaccttgtataatcttggaatcacacttctctccgcgtacatgctggcagagctcattctctccacttgggaaggaggctacaacttacagtgtcaagatcttaccagcgcaggggaagctgacatccgggtagccaaggtgctttggtggtactatttctccaaatcagtagagttcctggacacaattttcttcgttttgcggaaaaaaacgagtcagattacttttcttcatgtatatcatcatgcttctatgtttaacatctggtggtgtgtcttgaactggataccttgtggacaaagtttctttggaccaacactgaacagttttgtccacattcttatgtactcctactatggactttctgtgtttccatctatgcacaagtatctttggtggaagaaatatctcacacaggctcagctggtgcagttcgtgctcaccatcacgcacaccatgagcgccgtcgtgaaaccgtgtggcttccccttcggttgtctcatcttccagtcatcttatatgctaacgttagtcatcctcttcttaaatttttatgttcagacataccgaaaaaagccaatgaagaaagatatgcaagagccacctgcagggaaagaagtgaagaatggtttttccaaagcctacttcactgcagcaaatggagtgatgaacaagaaagcacaataaaaatgagtaacagaaaaagcacatatactagcctaacagattggcttgttttaaagcaaagactgaattgaaggttacatgttttaggataaactaatttcttttgagttcataaatcatttgtacccagaatgtattaatatattgctattaggttaatctgttaactgaatgctttgatcagcattgaggtgatgctcacctccgaggacctcagaactggtgcagcttctctctccctccctcccacagactgaacctttcgccagaagctgtccttataacgccttatacgcatacacagccaggaaacgtggagcattgtttctcacagagagtctccaaataaaaagggttttgttcagattaaaatgtttacaacaaaatgttaattatattctaaatacagggtatgttctaatctatattaagcaataatgccagtgcataatcattccatttgttcctttagcaatcaaccccagaaaatattaaaatgggatcatacacagaagatagaaaaatctagcaaaacttctctttctgtaagccagagtcttgtctatcagattcccacaaccactcctgattctaaatttagtgatatggtaatgaaattggtatttattttaaatattagttattctaaggagaaaaaaatgcttctgcaagattttcataattcaggggctgtggataggattgttcctctgtttccctaatcattcatctgttcatgtctccctcttgtgccagtcagcctaggttatacagatgccatgctccacaccacgagcagtgtacaaatctggctgcccgtttactttctgagcaagcactggagtccactccgacctttttctttgaacatgcatgctgctggaatatgtataaatcagaactagcagaagtagcagagtgatgggagcaaaataggcactgaattcgtcaactcttttttgtgagcctacttgtgaatattacctcagatacctgttgtcactcttcacaggttatttaagttcttgaagctgggaggaaaaagatggagtagcttggaaagattccagcactgagccgtgagccggtcatgagccacgataaaaaatgccagtttggcaaactcagcactcctgttccctgctcaggtatatgcgatctctactgagaagcaagcacaaaagtagaccaaagtattaatgagtatttcctttctccataagtgcaggactgttactcactactaaactctaccaagaatggaaaccaagaatattttctgaagatttttttgaagattaatttataccctataaaataaaacttgttagcttcgatgaagtcaaaaaaaaaaaaaaaaaaaaa

SEQ ID NO: 44 - DNA, 7475 bp, homo sapiens
acttcagacgccgctgatccgggaggagctggggtgagccgcggcggccgtctctcccacccgcagcagcatcctctctgcccttctctgccaccccggggagagccgggagctgcctctttacagcttccacgagccaggggtgcaggcagctgcccccaggaagtttgggcttctgcgtagtttaggggtgcctgcgagcgccccagagggcgaggggccgagggcgatgttgggcgccgcgcggggctgggggcgcccagaagacgtgcgagtgtccgcggtcctgctgctgtctccagtaccctccgcatcccccaagtgatgggaacaagggcccgcccaggcagccgctgtcgccgcaccgccccctcgctcgctctctgcgcgcggagtcacccagtcacactcccggcaccccgagcccttcctccggagctgctgcttctactttggctgctatcgccgccgccgcgggtggcccgctgctgactgggctcgccgggagacggagaagcactttttggccctccctcagcagctctcacaccccaactttgccgccgccgccgcgcctgccctcgcagcggcgctcggccgcacattgtgggggcgcacgccgggaggctccgcaagaccgtggaggcaggaaacggcactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggcctaaatttcttctggtagtgtcagttcaactttcagaagtgccacttaaggaagtttgatttttgtttttgtaatgcactgtttttaatctctctctctttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaatac

SEQ ID NO: 45 - DNA, 1898 bp, homo sapiens
agcgcagtatggcgggcggggcccgggaggtgctcacactgcagttgggacattttgccggtttcgtgggcgcgcactggtggaaccagcaggatgctgcgctgggccgagcgaccgattccaaggagcccccgggagagctgtgccccgacgtcctgtatcgtacgggccggacgctgcacggccaggagacctacacgccgcgactcatcctcatggatctgaagggtagtttgagctccctaaaagaggaaggtggactctacagggacaaacagttggatgctgcaatagcatggcaggggaagctcaccacacacaaagaggaactctatcccaagaacccttatctccaagactttctgagtgcagagggagtgctgagtagtgatggtgtctggagggtcaaatccattcccaatggcaaaggttcctcaccactccccaccgctacaactccaaaaccacttatccctacagaggccagcatcagggtctggtcagacttcctcagagtccatctccatccccggagcatctgtatgattcagaagtacaaccacgatggggaagcaggtcggctggaggcttttggccaaggggaaagtgtcctaaaggaacccaagtaccaggaagagctggaggacaggctgcatttctacgtggaggaatgtgactacttgcagggcttccagatcctgtgtgacctgcacgatggcttctctggggtaggcgcgaaggcggcagagctgctacaagatgaatattcagggcggggaataataacctggggcctgctacctggtccctaccatcgtggggaggcccagagaaacatctatcgtctattaaacacagcttttggtctcgtgcacctgactgctcacagctctcttgtctgccccttgtccttgggtgggagcctgggcctgcgacccgagccacctgtcagcttcccttacctgcattatgatgccactctgcccttccactgcagtgccatcctggctacagccctggacacagtcactgttccttatcgcctgtgttcctctccagtttccatggttcatctggctgacatgctgagcttctgtgggaaaaaggtggtgacagcaggagcaatcatccctttccccttggctccaggccagtcccttcctgattccctggtgcagtttggaggagccaccccatggaccccactgtctgcatgtggggagccttctggaacacgttgctttgcccagtcagtggtgctgaggggtatagacagagcatgccacacaagccagctcaccccagggacacctccaccctctgcccttcatgcatgtaccactggggaagaaatcttggctcagtatttacaacagcagcagcctggagtcatgagttcttcccatctgctgctgactccctgcagggtggctcctccttacccccacctcttctcaagctgcagtccaccgggtatggttctggatggttcccccaagggagcagcagtggagagcatcccagtgtttggggcactgtgttcctcttcgtccctgcaccagaccctggaagccttggccagagacctcaccaaactcgacttgcggcgctgggccagcttcatggatgctggagtggagcacgatgacgtagcagagctgctgcaggagctacaaagcctggcccagtgctaccagggtggtgacagcctcgtggactaaagttcccagtgtgggagaaaggagctagtttgcaataaaaacagctggatgcaggagcccagtgtcttcatgcagaggagctcaatgtcgcgggactagctacaccaacatatgcactttttacatttagaaacactgtgattagaccacagaacaataaatatgtgccatcagacc

SEQ ID NO: 46 - DNA, 782 bp, homo sapiens
gggctccctgcctcgggctctcaccctcctctcctgcagctccagctttgtgctctgcctctgaggagaccatggcccagtatctgagtaccctgctgctcctgctggccaccctagctgtggccctggcctggagccccaaggaggaggataggataatcccgggtggcatctataacgcagacctcaatgatgagtgggtacagcgtgcccttcacttcgccatcagcgagtataacaaggccaccaaagatgactactacagacgtccgctgcgggtactaagagccaggcaacagaccgttgggggggtgaattacttcttcgacgtagaggtgggccgcaccatatgtaccaagtcccagcccaacttggacacctgtgccttccatgaacagccagaactgcagaagaaacagttgtgctctttcgagatctacgaagttccctgggagaacagaaggtccctggtgaaatccaggtgtcaagaatcctagggatctgtgccaggccattcgcaccagccaccacccactcccaccccctgtagtgctcccacccctggactggtggcccccaccctgcgggaggcctccccatgtgcctgcgccaagagacagacagagaaggctgcaggagtcctttgttgctcagcagggcgctctgccctccctccttccttcttgcttctaatagccctggtacatggtacacacccccccacctcctgcaattaaacagtagcatcgcctccctctgaaaaaaaaaaaaaaaaaaaaaaa

SEQ ID NO: 47 - DNA, 1107 bp, homo sapiens
ggcacgaggggctggcggccggcgggagaggcggccggcctggactggcccgagagggatcccggttcccagaacagacctaggaggcggcctcgagggcggacggcagggagggccagcatgccccgactgctgcaccccgccctgccgctgctcctgggcgccacgctgaccttccgggcgctccggcgcgcgctctgtcgcctgcccctacccgtgcacgtgcgcgccgaccccctgcgcacctggcgctggcacaacctgctcgtctccttcgctcactccattgtgtcggggatctgggcactgctgtgtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaagtatgtgaacctggtcatgtactttctcttccgcctggcccctcaggcctacctcacccatttcttcttgcgttatgtgaaccagaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtgaggggcacagagcctgggacaacaaaaacggacaaggccagaaacagcttcatatggacactgggacttagccccaagcctgggtgtcctctgaggccagcctctccaccttctgagcctgcgcccacactattgaaaacactaatgaaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 48 - DNA, 1027 bp, homo sapiens
aggcccgtggatctcatcgaagatggcggcgcgatctgtgtcgggcattaccagaagagtcttcatgtggacagtctcagggacaccatgtagagaattttggtctcgattcagaaaagagaaagagccagtggttgttgagacagtagaagagaaaaaggaacctatcctagtgtgtccacctttacgaagccgagcatacacaccacctgaagatctccagagtcgtttggaatcttacgttaaagaagtttttggttcatctcttcctagtaattggcaagacatctccctggaagatagtcgtctaaagttcaatcttctggctcatttagctgatgacttgggtcatgtagtccctaactccagactccaccagatgtgcagggttagagatgttcttgatttctataatgtccctattcaagatagatctaaatttgatgaactcagtgccagtaatctgccccccaatttgaaaatcacttggagttactaagcaattcggaagagaaacacattgaaatcactgtctttccctgagcaagggggctgctcattagatcttttgatactttaccatgtgaaatactaccagaactgttctctaaacccactttttctgtagaggaatgtatcatctttttttttctcatattacaaatggacaaataacggactttctattttcatatttgctgaaaccattttttaaatgaaattaggtcattatttatgaaaagttttgagagggcactgtcaacttgggtttaagacaggaggacattgcaagttcacacctttcataagcataaagtagttgcaagaaagtattttcatcctgttaggattcatatctaagatagagttatgcattgcacatacacaaataaacttttattagatagatacctataaaagaaacataaaagtatgttgtgtattactgacagttctagattaatttcttttagaattaaagtagatttgttaaagtgaaaaaaaaaaaaaaaaaaaaaaaaaaaaa

SEQ ID NO: 49 - DNA, 1923 bp, homo sapiens
ctttcccggaggctggcagatgcgcgtggtgcggctgctgcggctccgggcggctctgacgctgctcggggaggtcccccgccgcccggcctcccggggtgtcccgggctcgcgcaggacgcagaagggcagtggagccaggtgggagaaggagaagcacgaagacggggtgaagtggagacagctggagcacaagggcccgtacttcgcacccccatacgagccccttcccgacggagtgcgtttcttctatgaaggaaggcctgtgagattgagcgtggcagcggaggaggtcgccactttttatgggaggatgttagatcatgaatacacaacaaaggaggttttccggaagaacttcttcaatgactggcgaaaggaaatggcggtggaagagagggaagtcatcaagagcctggacaagtgtgacttcacggagatccacagatactttgtggacaaggccgcagcccggaaagtcctgagcagggaggagaagcagaagctaaaagaagaggcagaaaaacttcagcaagagttcggctactgtattttagatggtcaccaagaaaaaataggcaacttcaagattgagccgcctggcttgttccgtggccgtggcgaccatcccaagatggggatgctgaagagaaggatcacgccagaggatgtggttatcaactgcagcagggactcgaagatccccgagccgccggcggggcaccagtggaaggaggtgcgctccgataacaccgtcacgtggctggcagcttggaccgagagcgttcagaactccatcaagtacatcatgctgaacccttgctcgaagctgaagggggagacagcttggcagaagtttgaaacagctcgacgcctgcggggatttgtggacgagatccgctcccagtaccgggctgactggaagtctcgggaaatgaagacgagacagcgggcggtggccctgtatttcatcgataagctggcactgagagcaggaaatgagaaggaggacggtgaggcggccgacaccgtgggctgctgttccctccgcgtggagcacgtccagctgcacccggaggccgatggctgccaacacgtggtggaatttgacttcctggggaaggactgcatccgctactacaacagagtgccggtggagaagccggtgtacaagaacttacagctctttatggagaacaaggacccccgggacgacctcttcgacaggctgaccacgaccagcctgaacaagcacctccaggagctgatggacgggctgacggccaaggtgttccggacctacaacgcctccatcactctgcaggagcagctgcgggccctgacgcgcgccgaggacagcatagcagctaagatcttatcctacaaccgagccaaccgagtcgtggccattctctgcaaccatcagcgagcaacccccagtacgttcgagaagtcgatgcagaatctccagacgaagatccaggcaaagaaggagcaggtggctgaggccagggcagagctgaggagggcgagggctgagcacaaagcccaaggggatggcaagtccaggagtgtcctggagaagaagaggcggctcctggagaagctgcaggagcagctggcgcagctgagtgtgcaggccacggacaaggaggagaacaagcaggtggccctgggcacgtccaagctcaactacctggaccccaggatcagcattgcctggtgcaagcggttcagggtgccagtggagaagatctacagcaaaacacagcgggagaggttcgcctgggctctcgccatggcaggagaagactttgaattctaacgacgagccgtgttgaaacttcttttgtatgtgtgtgtgtttttttcactattaaagcagtactggggaattttgtacaataaaaaaaaaaaaaaaaa

SEQ ID NO: 50 - DNA, 1794 bp, homo sapiens
cacatataataatagcaactcctggtcgactgattgaccacttgaaacctttcgtattttccaagtgctggcaagcgcttcctgcgcaggccgaggcgacctggagtttgtgacgctgtgatggtctagaggctggagattcaagatctgggtgccatcattttctggttctgttgatgaccctcttccaggttacatacagcttacatcttgcatcctcaagcgtttttcttataaggctaaaaattcacaaagcatatatcaatgaatcaggaggatctagatccggatagtactacagatgtgggagatgttacaaatactgaagaagaacttattagagaatgtgaagaaatgtggaaagatatggaagaatgtcagaataaattatcacttattggaactgaaacactcaccgattcaaatgctcagctatcattgttaattatgcaagtaaaatgtttaaccgctgaactcagtcaatggcagaaaaaaacacctgaaacaattcccttgactgaagacgttctcataacattaggaaaagaagagttccaaaagctgagacaagatcttgaaatggtactgtccactaaggagtcaaagaatgaaaagttaaaggaagacttagaaagggaacaacggtggttggatgaacagcaacagataatggaatctcttaatgtactacacagtgaattgaaaaataaggttgaaacattttctgaatcaagaatctttaatgaactgaaaactaaaatgcttaatataaaagaatataaggagaaactcttgagtaccttgggcgagtttctagaagaccattttcctctgcctgatagaagtgttaaaaagaaaaagaaaaacattcaagaatcatctgtaaacctgataacactgcatgaaatgttagagattcttataaatagattatttgatgttccacatgatccatatgtcaaaattagtgattccttttggccaccttatgttgagctgctgctgcgtaatggaattgccttgagacatccagaagatccaacccgaataagattagaagctttccatcagtaaaaggatgttttcttttttcacacagtaaaaattcttatcattcaaggatattggaaccacaggactatttggataaaaaacattatttgcaaattaatgcgcatagtacttttattgcaaaatggcatgtgctgccatctattattcatttttaaatggtcatttcttattcagtgagtgctttagtgttttaaactatatggataagaatgcaggtagataatattctaggcataaaacatttaatgtaccttacctcatgcaatattctttggattctttgttgatttatgatattgctaatataatattttcttaaaatatataacaatatcttttatgcatttgagttccagctggtgcttctttatatttagaaattataatgggaaggtcatttaatttacagatggttttaaaattgaggtaatatctgaggtggcataatttaaaaatatttagcaaatttgtttcatatatactgtcttatttctagatttgtttaaaattggaatatgaaaaactaatggataaagctagcataaaattgatattttagtttgtattattaatatatcatgttaccttatatattaatctactcttgattctgctaattattaccaacaaaattgtattcatgacattttattaatcctctgtgaattttctgtaaataaaattatttctgaaaatctctaaaaaaaaaaaaaaaaaaaa

SEQ ID NO: 51 - DNA, 3205 bp, homo sapiens
aaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacggatgaggatgatgccatctacacctacaatggggtggttgcttactccatccatagccaagaaccaaaggacccacacgacctcatgttcaccattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaatgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggttgcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttcccagaaaaaaa

SEQ ID NO: 52 - DNA, 2781 bp, homo sapiens
atggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactacgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtaaaaacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatga

SEQ ID NO: 53 - DNA, 1294 bp, homo sapiens
caaagccacaggcaggtgcaggcgcagccgcggcgagagcgtatggagccgagccgttagcgcgcgccgtcggtgagtcagtccgtccgtccgtccgtccgtcggggcgccgcagctcccgccaggcccagcggccccggcccctcgtctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgcagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcccagtgcaccaactgcgtgcaggacgacacggccaaggccaagatcaccatcgtggcaggcgtgctgttccttctcgccgccctgctcaccctcgtgccggtgtcctggtcggccaacaccattatccgggacttctacaaccccgtggtgcccgaggcgcagaagcgcgagatgggcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcaaggactacgtctaagggacagacgcagggagaccccaccaccaccaccaccaccaacaccaccaccaccaccgcgagctggagcgcgcaccaggccatccagcgtgcagccttgcctcggaggccagcccacccccagaagccaggaagcccccgcgctggactggggcagcttccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgctcgcgctgggcagggaccggcagccctggaaggggcacttgatatttttcaataaaagcctttcgttttgcaaaaaaaaaaaaaaaaaaaaaaaaaaaaaaaaaaaaaaaaaaaaa

SEQ ID NO: 54 - DNA, 1712 bp, homo sapiens
ggcacgaggggcagctgtcggctggaaggaactggtctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgcggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatggcttaaccctgactttgggatctgcctgcatcggtgttggccactgtccccatttacattttccccactctgtctgcctgcatctcctctgttgcgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacaggaaaaaaaaaaaaaaaaaaaaaaaa

SEQ ID NO: 55 - DNA, 2820 bp, homo sapiens
ggcgggttcgcgccccgaaggctgagagctggcgctgctcgtgccctgtgtgccagacggcggagctccgcggccggaccccgcggccccgctttgctgccgactggagtttgggggaagaaactctcctgcgccccagaagatttcttcctcggcgaagggacagcgaaagatgagggtggcaggaagagaaggcgctttctgtctgccggggtcgcagcgcgagagggcagtgccatgttcctctccatcctagtggcgctgtgcctgtggctgcacctggcgctgggcgtgcgcggcgcgccctgcgaggcggtgcgcatccctatgtgccggcacatgccctggaacatcacgcggatgcccaaccacctgcaccacagcacgcaggagaacgccatcctggccatcgagcagtacgaggagctggtggacgtgaactgcagcgccgtgctgcgcttcttcttctgtgccatgtacgcgcccatttgcaccctggagttcctgcacgaccctatcaagccgtgcaagtcggtgtgccaacgcgcgcgcgacgactgcgagcccctcatgaagatgtacaaccacagctggcccgaaagcctggcctgcgacgagctgcctgtctatgaccgtggcgtgtgcatttcgcctgaagccatcgtcacggacctcccggaggatgttaagtggatagacatcacaccagacatgatggtacaggaaaggcctcttgatgttgactgtaaacgcctaagccccgatcggtgcaagtgtaaaaaggtgaagccaactttggcaacgtatctcagcaaaaactacagctatgttattcatgccaaaataaaagctgtgcagaggagtggctgcaatgaggtcacaacggtggtggatgtaaaagagatcttcaagtcctcatcacccatccctcgaactcaagtcccgctcattacaaattcttcttgccagtgtccacacatcctgccccatcaagatgttctcatcatgtgttacgagtggcgttcaaggatgatgcttcttgaaaattgcttagttgaaaaatggagagatcagcttagtaaaagatccatacagtgggaagagaggctgcaggaacagcggagaacagttcaggacaagaagaaaacagccgggcgcaccagtcgtagtaatccccccaaaccaaagggaaagcctcctgctcccaaaccagccagtcccaagaagaacattaaaactaggagtgcccagaagagaacaaacccgaaaagagtgtgagctaactagtttccaaagcggagacttccgacttccttacaggatgaggctgggcattgcctgggacagcctatgtaaggccatgtgccccttgccctaacaactcactgcagtgctcttcatagacacatcttgcagcatttttcttaaggctatgcttcagtttttctttgtaagccatcacaagccatagtggtaggtttgccctttggtacagaaggtgagttaaagctggtggaaaaggcttattgcattgcattcagagtaacctgtgtgcatactctagaagagtagggaaaataatgcttgttacaattcgacctaatatgtgcattgtaaaataaatgccatatttcaaacaaaacacgtaatttttttacagtatgttttattaccttttgatatctgttgttgcaatgttagtgatgttttaaaatgtgatgaaaatataatgtttttaagaaggaacagtagtggaatgaatgttaaaagatctttatgtgtttatggtctgcagaaggatttttgtgatgaaaggggattttttgaaaaattagagaagtagcatatggaaaattataatgtgtttttttaccaatgacttcagtttctgtttttagctagaaacttaaaaacaaaaataataataaagaaaaataaataaaaaggagaggcagacaatgtctggattcctgttttttggttacctgatttccatgatcatgatgcttcttgtcaacaccctcttaagcagcaccagaaacagtgagtttgtctgtaccattaggagttaggtactaattagttggctaatgctcaagtattttatacccacaagagaggtatgtcactcatcttacttcccaggacatccaccctgagaataatttgacaagcttaaaaatggccttcatgtgagtgccaaattttgtttttcttcatttaaatattttctttgcctaaatacatgtgagaggagttaaatataaatgtacagagaggaaagttgagttccacctctgaaatgagaattacttgacagttgggatactttaatcagaaaaaaagaacttatttgcagcattttatcaacaaatttcataattgtggacaattggaggcatttattttaaaaaacaattttattggccttttgctaacacagtaagcatgtattttataaggcattcaataaatgcacaacgcccaaaggaaataaaatcctatctaatcctactctccactacacagaggtaatcactattagtattttggcatattattctccaggtgtttgcttatgcacttataaaatgatttgaacaaataaaactaggaacctgtatacatgtgtttcataacctgcctcctttgcttggccctttattgagataagttttcctgtcaagaaagcagaaaccatctcatttctaacagctgtgttatattccatagtatgcattactcaacaaactgttgtgctattggatacttaggtggtttcttcactgacaatactgaataaacatctcaccggaattc

SEQ ID NO: 56 - DNA, 1858 bp, homo sapiens
gctgcggccccgccccctggccgcgtggctgcgcgtcctggctgttgccgataaagttgtttgacgccggcccggcggcgggtcacgtgagcggaaaatggcggccccggcaggcggcggaggctccgcggtgtcggtgctggccccgaacggccggcgccacacggtgaaggtgacgccgagcaccgtgctgcttcaggttctggaggacacgtgccggcggcaggacttcaacccctgtgaatatgatctgaagtttcagaggagcgtgctcgacctttctctccagtggagatttgccaacctgcccaacaatgccaagctggagatggtgcccgcttcccggagccgtgaggggcctgagaacatggttcgcatcgctttgcagctggacgatggctcgaggttgcaggactctttctgttcaggccagaccctctgggagcttctcagccattttccacagatcagggagtgcctgcagcaccccggcggggccaccccagtctgcgtgtacacgagggatgaggtgacgggtgaagctgccctgcggggcacgacgctgcagtcgctgggcctgaccgggggcagcgccaccatcaggtttgtcatgaagtgctacgaccccgtgggcaagaccccaggaagcctgggctcgtcagcgtcggctggccaggcagccgccagcgctccacttcccttggaatctggggagctcagccgcggcgacttgagccgtccggaggacgcggacacctcagggccctgctgcgagcacactcaggagaagcagagcacaagggcacccgcagctgccccctttgttcctttctcgggtgggggacagagactggggggccctcctgggcccacgaggcctctgacatcatcttcagctaagttgccgaagtccctctccagccctggaggcccctccaagccaaagaagtccaagtcgggccaggatccccagcaggagcaggagcaggagcgggagcgggatccccagcaggagcaggagcgggagcggcccgtggaccgggagcccgtggaccgggagccggtggtgtgccaccccgacctggaggagcggctgcaggcctggccagcggagctgcctgatgagttctttgagctgacggtggacgacgtgagaagacgcttggcccagctcaagagtgagcggaagcgcctggaagaagcccccttggtgaccaaggccttcagggaggcgcagataaaggagaagctggagcgctacccaaaggtggctctgagggtcctgttccccgaccgctacgtcctacagggcttcttccgccccagcgagacagtgggggacttgcgagacttcgtgaggagccacctggggaaccccgagctgtcattttacctgttcatcacccctccaaaaacagtcctggacgaccacacgcagaccctctttcaggcgaacctcttcccggccgctctggtgcacttgggagccgaggagccggcaggtgtctacctggagcctggcctgctggagcatgccatctccccatctgcggccgacgtgctggtggccaggtacatgtccagggccgccgggtccccttccccattgccagcccctgaccctgcacctaagtctgagccagctgctgaggagggggcgctggtcccccctgagcccatcccagggacggcccagcccgtgaagaggagcctgggcaaggtgcccaagtggctgaagctgccggccagcaagaggtgagagctgccagcctgaggtgcccactccgccagccacaggaccacctcctctgccagcaggaataaagacttgtgcatccctcaaaaaaaaaaaaaaaaa

SEQ ID NO: 57 - DNA, 493 bp, homo sapiens
gccacttctcttcccttcattcttcgccaggctctctgctgactcaagttcttcagttcacgatcttctagttgcagcgatgagtgcacgagtgagatcaagatccagaggaagaggagatggtcaggaggctcccgatgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcctaagcatgctaagactaaagaagcaggagatgggcagccataagttaaaaagaagacaagctgaagctacacacatggctgatgtcacattgaaaatgtgactgaaaatttgaaaattctctcaataaagtttgagttttctctgaag

SEQ ID NO: 58 - DNA, 2957 bp, homo sapiens
gccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaagattcgtgttcttctacaggaacgtggtgcccaggacagccggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcatttaaccaaaaaaaaaaaaaaaa

SEQ ID NO: 59 - DNA, 6399 bp, homo sapiens
catccttcctgtcttcgcagaggagtcctcgcgtgaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagcaccagggatttctcagttgatcgtgtccgtgtctgcttcgtgacaagcatgatgaccggccgtgctgcccgttgggcctcagcaaagctggagcgctcccactacctgatgcacaactacccagctttcatgatggaaatgaagcatgtctttgaagaccctcagaggcgagaggttgccaaacgcaagatcagacgcctgcgccaaggcatggggtctgtcatcgactactccaatgctttccagatgattgcccaggacctggattggaacgagcctgcgctgattgaccagtaccacgagggcctcagcgaccacattcaggaggagctctcccacctcgaggtcgccaagtcgctgtctgctctgattgggcagtgcattcacattgagagaaggctggccagggctgctgcagctcgcaagccacgctcgccaccccgggcgctggtgttgcctcacattgcaagccaccaccaggtagatccaaccgagccggtgggaggtgcccgcatgcgcctgacgcaggaagaaaaagaaagacgcagaaagctgaacctgtgcctctactgtggaacaggaggtcactacgctgacaattgtcctgccaaggcctcaaagtcttcgccggcgggaaactccccggccccgctgtagagggaccttcagcgaccgggccagaaataataaggtccccacaagatgatgcctcatctccacacttgcaagtgatgctccagattcatcttccgggcagacacaccctgttcgtccgagccatgatcgattctggtgcttctggcaacttcattgatcacgaatatgttgctcaaaatggaattcctctaagaatcaaggactggccaatacttgtggaagcaattgatgggcgccccatagcatcgggcccagttgtccacgaaactcacgacctgatagttgacctgggagatcaccgagaggtgctgtcatttgatgtgactcagtctccattcttccctgtcgtcctaggggttcgctggctgagcacacatgatcccaatatcacatggagcactcgatctatcgtctttgattctgaatactgccgctaccactgccggatgtattctccaataccaccatcgctcccaccaccagcaccacaaccgccactctattatccagtagatggatacagagtttaccaaccagtgaggtattactatgtccagaatgtgtacactccagtagatgagcacgtctacccagatcaccgcctggttgaccctcacatagaaatgatacctggagcacacagtattcccagtggacatgtgtattcactgtccgaacctgaaatggcagctcttcgagattttgtggcaagaaatgtaaaagatgggctaattactccaacgattgcacctaatggagcccaagttctccaggtgaagagggggtggaaactgcaagtttcttatgattgccgagctccaaacaattttactatccagaatcagtatcctcgcctatctattccaaatttagaagaccaagcacacctggcaacgtacactgaattcgtacctcaaatacctggataccaaacataccccacatatgccgcgtacccgacctacccagtaggattcgcctggtacccagtgggacgagacggacaaggaagatcactatatgtacctgtgatgatcacttggaatccacactggtaccgccagcctccggtaccacagtacccgccgccacagccgccgcctccaccaccaccaccgccgccgcctccatcttacagtaccctgtaaatacctgtcatgtccttcaggatctctgccctcaaaatttattcctgttcagcttctcaatcagtgactgtgtgctaaattttaggctactgtatcttcaggccacctgaggcacatcctctctgaaacggctatggaaggttagggccactctggactggcacacatcctaaagcaccaaaagaccttcaacattttctgagagcaacagagtatttgccaataaatgatctctcatttttccaccttgactgccaatctaactaacaataattaataagtttactttccagccagtcctggaagtctgggttttacctgccaaaacctccatcaccatctaaattataggctgccaaatttgctgtttaacatttacagagaagctgatacaaacgcaggaaatgctgatttctttatggagggggagacgaggaggaggaggacatgacttttcttgcggtttcggtaccctctttttaaatcactggaggactgaggccttattaaggaagccaaaattatcggtgcagtgtggaaaggcttccgtgatcctctcgctgcacccttagaaacttcaccgtcttcaaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatcygctcttattctttgcatgtttaaacactttaaaattttttagtataatttttagtgtgttttgaagtggtgactaggctttcaaaaacttccatttgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaacttttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgc

SEQ ID NO: 60 - DNA, 811 bp, homo sapiens
catccctctggctccagagctcagagccacccacagccgcagccatgctgtgcctcctgctcaccctgggcgtggccctggtctgtggtgtcccggccatggacatcccccagaccaagcaggacctggagctcccaaagttggcagggacctggcactccatggccatggcgaccaacaacatctccctcatggcgacactgaaggcccctctgagggtccacatcacctcactgttgcccacccccgaggacaacctggagatcgttctgcacagatgggagaacaacagctgtgttgagaagaaggtccttggagagaagactgggaatccaaagaagttcaagatcaactatacggtggcgaacgaggccacgctgctcgatactgactacgacaatttcctgtttctctgcctacaggacaccaccacccccatccagagcatgatgtgccagtacctggccagagtcctggtggaggacgatgagatcatgcagggattcatcagggctttcaggcccctgcccaggcacctatggtacttgctggacttgaaacagatggaagagccgtgccgtttctagctcacctccgcctccaggaagaccagactcccacccttccacacctccagagcagtgggacttcctcctgccctttcaaagaataaccacagctcagaagacgatgacgtggtcatctgtgtcgccatccccttcctgctgcacacctgcaccattgccatggggaggctgctccctgggggcagagtctctggcagaggttattaataaacccttggagcatg

SEQ ID NO: 61 - DNA, 1685 bp, homo sapiens
gtcaaaggaagttagtacattaaacaaatggtggtaggagggaggatttggcccaactggctccaacctatctggtcaacacgtatgttgggtagaacagaggtggagaaaagcctagatcagggatgtatacgcttccttggggcagacgcagcctggccctgcggagcgatttcaagcctcgttcacgaacatggccaaggacactgccagcctcttcattcccctgtgtggatgctccaactccaaaagtggaaccacagggcaaatgaatgtcggcacgtgtcggtatggcagcctcgctcttcgacagctggtgtgggggttaccacctggggctagctggcctcatcttcgttagcactgagactggtctaccagttgcacagattcagatttgaaaatctcaggtgcaaatcccaagtggcgatggcatgtaaccacatcaaactcaacatctgcacctaactcccaccttctttctctgggaaatcttcctggacatgcccagatggactcaggagcccatcacctgtaaatccccacactgcagccctgccacttgcttgtctgcatgtgtgggtccgctggaccactttggtgtatctttgagccccttgagtgaaaaaatgctgcctggctggctccctgattagacatccaacataatgaggactaacaccaatacaaacacttaagagatgacatatcgccctagctggatctactacagggaagggaagagggtgctgggtccaggcaggctgagtgtctcatgtcttaatgcttctctgcccaatctatttccggctggatgtggagtctgaaggcctggcacccactctggctctgtgatttaccagctgtgagccttgggggagctgcttactctcttggtgattcttttctcatttctatgatggggtagaggataatgcctatgcttacaaagtggctgtgggaagtaaaccggatgggataagaatggcttgctgtggaccacaggcaccgcaggataaccattcctcagaactcctcgtactgctctagtgcttggaggtccgtgtattacctcagctattccaaccgcaccaaccacgggagccacgtgtctacgtctgacagataaagatgctgagtttagagtctgcaaggcttgacaaccacagatcagggacaggagctgaggtctcctgacctggagcccagggccacccggagctgcaagaaacctgcactcacaactgcctcctattttaaaatgctgagtcgatcccacaggtggcaaaccagttctgggcttcaatttacaagcagtcagaaaagctgggttgaaatcgccactgtccttctatgtggctgatgaggaaggatgacggtgcccaccgctccatctctccagctgaccccaagctggcactcacgggtgggcaggctcagacaggcccagctccaccaagtgcacttgaagccggaatgcaagacatccgatggtatacttactcgaacccgtccttttcacaacagccgcgggatccgctttctttggctgactgctcagagtcttcccttttcctgtgaccccattagacgccatggggggctttttacccttgagctgttgaaataaacatataagaacattaaaaataaacacaaagtcaaacaaaaaaaaaaaaaaaaaa

SEQ ID NO: 62 - DNA, 2303 bp, homo sapiens
cgcttcccgccgcccgagcttcggaaacttcccggccgcgacgcagggaaccggcgcggagaaccgagcagagcggagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaagcccaggtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagaggtgcagtggccgcccacatccatggcctaggagctactgggcaggttcccggccacacatctggtgggctgttttgtttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagataaaaaaaaaaaaaaaaaaa

SEQ ID NO: 63 - DNA, 4578 bp, homo sapiens
agcgggtcgtgggcagccgcctcacagcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaaggatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggaatgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaaaaaaaaaaaaaaaa

SEQ ID NO: 64 - DNA, 5542 bp, homo sapiens
gtaattgacaaagtcacgtgtgctcagggggccagaaactggagagaggagagaaaaaaatcaaaagaaggaaagcacattagaccatgcgagctaaatttgtgatcgcacaaaatcaagatgttagattgatgcagaagatcactccgttccaaagggaaagttttcatctcacgagtttggagctgagggcccgtggggcaacatggccgaaggcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaaagcaaactattcatggaaggatttagaagcctaaaagaaggagaaccagtggaattcacatttaaaaaatcttccaaaggccttgagtcaatacgggtaacaggacctggtgggagcccctgtttaggaagtgaaagaagacccaaagggaagacactacagaaaagaaaaccaaagggagatagatgctacaactgtggtggccttgatcatcatgctaaggaatgtagtctacctcctcagccaaagaagtgccattactgtcagagcatcatgcacatggtggcaaactgcccacataaaaatgttgcacagccacccgcgagttctcagggaagacaggaagcagaatcccagccatgcacttcaactctccctcgagaagtgggaggcgggcatggctgtacatcaccaccgtttcctcaggaggctagggcagagatctcagaacggtcaggcaggtcacctcaagaagcttcctccacgaagtcatctatagcaccagaagagcaaagcaaaaaggggccttcagttcaaaaaaggaaaaagacataacaggtcttcttcatatgttctttcctttacccggttgcaaagtctacctcatgcaagtataggggaacagtatttcacaagcagtagctgacctgggattttaactactattggggaactgtgaattttttaaacagacaaatcactctaagcaaattacatttgagcagggtgtcatgttttatgttaattcagagaataagatactatgtctgtcaatatgtgcatgtgtgagagggagagagcctgagtctgtgtgtgtacatgaggatttttatataggaatgtagacacatatataaagaggctttgtctttatatatttgtgtatagatcaaagcacacaccctctctcatataattggatatttccaagaattgaaaacccatgtgaagcattatagatagttttaaatttaacccactggagttttcttgaaataccacttcttttatattatataaaactaaaaacacgactgttaccttttgtgtgaaccaaaggatacttcagatctcagagctgccaattatggggtactaaaggtttttaagacatccagttctcccgaatttgggattgcctctttttcttgaaatctctggagtagtaatttttttcccccttttttgaaggcagtaccttaacttcatatgcctctgactgccataagcttttttgattctgggataacataactccagaaaagacaatgaatgtgtaatttgggccgatatttcactgttttaaattctgtgtttaattgtaaaattagatgcctattaagagaaatgaaggggaggatcatcttagtggcttgttttcagtagtattttaatatcagcttcttgtaaccttttccatgttgtgagggttgtaagggattgtgtggcaacagcagcttcccttggctaactcaatcttctacccattgcttagagcagggagccctccttatttactactgaagaccttagagaactccaattgtttggcatatatttttggtggtggtttttattcctcctggagagttatctaatttgtttctaaaacaaacaagcagcaaagaaatgaattaaatactggggttgagaattaaaattaagtggatgttcacagttgcccaatatatatgacctgcaaatgatacgaaaaagtgcagcatttagtggcagttaacaagagtgacaagcctggggcagaggtaccaaacctctcccaccagagagctagaagtattttatacagtaactttgatcttatggaagtgaccttcaatgcttattctgaagtaacctatatggtggatacaggatgaacattcagtgccagggagaatcttctcaggttggttctcgttagagtgataaactggctaggggccatagtattggtcctgttaggtttcggtcatggaaaaaaaaattattttggggtcatcctggctctagatgttatgggcaaatttctgaaacatctgcaagaaggtaccagttaattatagtgcttaatattgggaataagattaagcattataattataatgtatgggcctgttggtgtaagctcagataattaaataaaaatagcatgactcaaatgagacatattctgctgaacagtttctacttcctctcccgcctgtcctgtcatgggagacgtgtatagttgctgctgtttcagcaaaccaccataagacgaaaatgcctcaggttgggttgccagtcctttacaactcagcttgaatttcacaacagtgattgtgagaatctgcgtggtatacactgaaatatcggtgtgctgtgatgcaaagcttacctttgacgatattgaatgtgatatagctgtagagaagtacttccttgccttatgtgaggatttcaaacttatttaaattatgtagacaaatcaaagtggcattgcttaatttttagcaggcataataagcaagttaacagtaaaatgcaaaacatgataagcgttgctcaatttttagcaggtataataagcaggttaacagtaaaaatgcaaaacatgatagataagtcactttgaaaattcaaaccaaagttccttcaccttatggaaataggaaattatggacttcaaaattggacacttcctgtttacaaaaagaaattcagagctaaaatcatggtaaaaaaaaatagaaacacttgagaactatggtctttatgggtgcaatttgaaatccttttcatcatcttaccagactaaactaagagcacataccaaacctatcttatggttgaaagttggggtttattttttatatgagaatattatcactattacataacatactcaggacaaagaactttgctcagggaacataccatgtaatatttttgttgtttctttacagactagtctacagtcctgcttactcaaaacaaaccaaataacttatacctttatataagtattatgtactgatgatagtaactacctctgagtttgacacagatcaaaatttttgaatatcagatatcagttatcctatttttatttcatgtgaaaactcctctaaagcagattccctcaactctgtgcatatgtgaatatcactgatgtgaacacattgttcatttacataggtaaaatattactctgtttacagcaaaaggctacctcatagttgatacatagcacacctgtatgtatgctgttccagccttacaggtggctgataattctctggtacagaacctttttatctgtattataaatagcaattcacaactgcatgtttctgacaaacacttgtgaataatgaagcatctcgttttagttagcaaagtctccaaacatttccttaaaataatcatgtatttagtttaaagaattatgggcactgttcaacttaagcaaaacagaacacggaagcagtcttagaagcaccactttgcccagaggtggaggttggaaggggtagcagggagaggggttggtgtatgcaggtattcatgctaggcaaagagtttaaaagacgccaatgtccttcatttactgtctgtgctgccctgaagccaagcgtattgcagcattatagccccaggcacataactaactagcactggcttgccaaggaatgaacatgcaatgccattactagctattgagggaaaagggtctgtgtgaagcatcactttgcagggattactaatggtggggcagcaggtctgtgaattaagttatctcttgacctcaccctcatgtcaacacaaatgtaattcctaaacaagatgcattgccagtctcttagccctgtaagctgatcttttgctacatggcagactataatgaaaacatttttatacttgggtttctagtcttcactagaaggccttggatgtatttttgcagttgaaagatttagaaagatttttacctgcttataacttggaagtttagagtgcaatgtaagaaaaaagatcaagaaatgtcatgttattagcatcagtccacctccaatattgccgatactttttttattctggctcagttttattttgcaccagtgcggccccaagttactgctggttgtatttagtttgtgaataggagcccataagtgttaatagactttgtaacattcactataagatgaattatacaggacatgggaaatctcattaagtcttaaagttaatttaaattaatttatctgttttctctaagaaatgtttatcataaaatatatatgtgtatttcccctttggttataaaatttgggaaagtatgtacaagtgcagctgcactgactttaattttctagatgtcttaatgagatttatttgttttagagaagaacatcttgttaaaagcatcaaactctgtcttacatagctgtcaacagcctctttaagatgtggtggttgtatgatctgtgtcttaattgttcagttagagtgagaagttgacctatgattcatttttaaattttatatttggaacaaagctgcaagttatggtaaagtactgtactgtgagaagtattatgatatttaatgcatctgtggcttaacacttgtgagagttaccagcttgaaaatgatggtgttgactacctcttgaatcacatctatcaaccactggcacctaccaccaagctggcttcaattagtatgtgttgctttttggtattaacaactaaccgtactagagaccaaagtgaaccctgatttttatatgtctttaataatggtgttttatctagtgtttttaaattatcctgtgtagtatttagattacctcattgtccattttgactcatgttgtttacaagtgaaaataaaaacacttgaactgtatgtttttaaaagacaaaaaaggggtagatgtttggaatgcgtttcactcgcatgcagtcatctggagggactgaagcactgtttgcctttctgtacactctgggttttatattctcatttcatgcctaatgtcttattctgtcaattatggatatgttgaggtttaaaaaaattacttgattaaaaataaaacatataacgttggcatttaaaaaaaaaaaaaaaaaaaaaaaaaaaaaaaaaaaa

SEQ ID NO: 65 - DNA, 5507 bp, homo sapiens
agtagctctaaaccatcttcacgatttctctttcctcctcgtgcccgccggagagaatagtttcgctgaaaatttctctttgtcaatgggatcagtattaaatcagcaatatacaagtaaagtatcgcatgctgtaatgtaaaatgtggctgaaaaatggagttaaatgaataagtacacgcggggctagcaaaggtggtggagaagagcccgggaagctgccggagccggcagaggaggaatcccaggttttgcgcggaactggccactgtaagtggttcaatgtgcgcatgggatttggattcatctccatgataaaccgagagggaagccccttggatattccagtcgatgtatttgtacaccaaagcaaactattcatggaaggatttagaagcctaaaagaaggagaaccagtggaattcacatttaaaaaatcttccaaaggccttgagtcaatacgggtaacaggacctggtgggagcccctgtttaggaagtgaaagaagacccaaagggaagacactacagaaaagaaaaccaaagggagatagatgctacaactgtggtggccttgatcatcatgctaaggaatgtagtctacctcctcagccaaagaagtgccattactgtcagagcatcatgcacatggtggcaaactgcccacataaaaatgttgcacagccacccgcgagttctcagggaagacaggaagcagaatcccagccatgcacttcaactctccctcgagaagtgggaggcgggcatggctgtacatcaccaccgtttcctcaggaggctagggcagagatctcagaacggtcaggcaggtcacctcaagaagcttcctccacgaagtcatctatagcaccagaagagcaaagcaaaaaggggccttcagttcaaaaaaggaaaaagacataacaggtcttcttcatatgttctttcctttacccggttgcaaagtctacctcatgcaagtataggggaacagtatttcacaagcagtagctgacctgggattttaactactattggggaactgtgaattttttaaacagacaaatcactctaagcaaattacatttgagcagggtgtcatgttttatgttaattcagagaataagatactatgtctgtcaatatgtgcatgtgtgagagggagagagcctgagtctgtgtgtgtacatgaggatttttatataggaatgtagacacatatataaagaggctttgtctttatatatttgtgtatagatcaaagcacacaccctctctcatataattggatatttccaagaattgaaaacccatgtgaagcattatagatagttttaaatttaacccactggagttttcttgaaataccacttcttttatattatataaaactaaaaacacgactgttaccttttgtgtgaaccaaaggatacttcagatctcagagctgccaattatggggtactaaaggtttttaagacatccagttctcccgaatttgggattgcctctttttcttgaaatctctggagtagtaatttttttcccccttttttgaaggcagtaccttaacttcatatgcctctgactgccataagcttttttgattctgggataacataactccagaaaagacaatgaatgtgtaatttgggccgatatttcactgttttaaattctgtgtttaattgtaaaattagatgcctattaagagaaatgaaggggaggatcatcttagtggcttgttttcagtagtattttaatatcagcttcttgtaaccttttccatgttgtgagggttgtaagggattgtgtggcaacagcagcttcccttggctaactcaatcttctacccattgcttagagcagggagccctccttatttactactgaagaccttagagaactccaattgtttggcatatatttttggtggtggtttttattcctcctggagagttatctaatttgtttctaaaacaaacaagcagcaaagaaatgaattaaatactggggttgagaattaaaattaagtggatgttcacagttgcccaatatatatgacctgcaaatgatacgaaaaagtgcagcatttagtggcagttaacaagagtgacaagcctggggcagaggtaccaaacctctcccaccagagagctagaagtattttatacagtaactttgatcttatggaagtgaccttcaatgcttattctgaagtaacctatatggtggatacaggatgaacattcagtgccagggagaatcttctcaggttggttctcgttagagtgataaactggctaggggccatagtattggtcctgttaggtttcggtcatggaaaaaaaaattattttggggtcatcctggctctagatgttatgggcaaatttctgaaacatctgcaagaaggtaccagttaattatagtgcttaatattgggaataagattaagcattataattataatgtatgggcctgttggtgtaagctcagataattaaataaaaatagcatgactcaaatgagacatattctgctgaacagtttctacttcctctcccgcctgtcctgtcatgggagacgtgtatagttgctgctgtttcagcaaaccaccataagacgaaaatgcctcaggttgggttgccagtcctttacaactcagcttgaatttcacaacagtgattgtgagaatctgcgtggtatacactgaaatatcggtgtgctgtgatgcaaagcttacctttgacgatattgaatgtgatatagctgtagagaagtacttccttgccttatgtgaggatttcaaacttatttaaattatgtagacaaatcaaagtggcattgcttaatttttagcaggcataataagcaagttaacagtaaaatgcaaaacatgataagcgttgctcaatttttagcaggtataataagcaggttaacagtaaaaatgcaaaacatgatagataagtcactttgaaaattcaaaccaaagttccttcaccttatggaaataggaaattatggacttcaaaattggacacttcctgtttacaaaaagaaattcagagctaaaatcatggtaaaaaaaaatagaaacacttgagaactatggtctttatgggtgcaatttgaaatccttttcatcatcttaccagactaaactaagagcacataccaaacctatcttatggttgaaagttggggtttattttttatatgagaatattatcactattacataacatactcaggacaaagaactttgctcagggaacataccatgtaatatttttgttgtttctttacagactagtctacagtcctgcttactcaaaacaaaccaaataacttatacctttatataagtattatgtactgatgatagtaactacctctgagtttgacacagatcaaaatttttgaatatcagatatcagttatcctatttttatttcatgtgaaaactcctctaaagcagattccctcaactctgtgcatatgtgaatatcactgatgtgaacacattgttcatttacataggtaaaatattactctgtttacagcaaaaggctacctcatagttgatacatagcacacctgtatgtatgctgttccagccttacaggtggctgataattctctggtacagaacctttttatctgtattataaatagcaattcacaactgcatgtttctgacaaacacttgtgaataatgaagcatctcgttttagttagcaaagtctccaaacatttccttaaaataatcatgtatttagtttaaagaattatgggcactgttcaacttaagcaaaacagaacacggaagcagtcttagaagcaccactttgcccagaggtggaggttggaaggggtagcagggagaggggttggtgtatgcaggtattcatgctaggcaaagagtttaaaagacgccaatgtccttcatttactgtctgtgctgccctgaagccaagcgtattgcagcattatagccccaggcacataactaactagcactggcttgccaaggaatgaacatgcaatgccattactagctattgagggaaaagggtctgtgtgaagcatcactttgcagggattactaatggtggggcagcaggtctgtgaattaagttatctcttgacctcaccctcatgtcaacacaaatgtaattcctaaacaagatgcattgccagtctcttagccctgtaagctgatcttttgctacatggcagactataatgaaaacatttttatacttgggtttctagtcttcactagaaggccttggatgtatttttgcagttgaaagatttagaaagatttttacctgcttataacttggaagtttagagtgcaatgtaagaaaaaagatcaagaaatgtcatgttattagcatcagtccacctccaatattgccgatactttttttattctggctcagttttattttgcaccagtgcggccccaagttactgctggttgtatttagtttgtgaataggagcccataagtgttaatagactttgtaacattcactataagatgaattatacaggacatgggaaatctcattaagtcttaaagttaatttaaattaatttatctgttttctctaagaaatgtttatcataaaatatatatgtgtatttcccctttggttataaaatttgggaaagtatgtacaagtgcagctgcactgactttaattttctagatgtcttaatgagatttatttgttttagagaagaacatcttgttaaaagcatcaaactctgtcttacatagctgtcaacagcctctttaagatgtggtggttgtatgatctgtgtcttaattgttcagttagagtgagaagttgacctatgattcatttttaaattttatatttggaacaaagctgcaagttatggtaaagtactgtactgtgagaagtattatgatatttaatgcatctgtggcttaacacttgtgagagttaccagcttgaaaatgatggtgttgactacctcttgaatcacatctatcaaccactggcacctaccaccaagctggcttcaattagtatgtgttgctttttggtattaacaactaaccgtactagagaccaaagtgaaccctgatttttatatgtctttaataatggtgttttatctagtgtttttaaattatcctgtgtagtatttagattacctcattgtccattttgactcatgttgtttacaagtgaaaataaaaacacttgaactgtatgtttttaaaagacaaaaaaggggtagatgtttggaatgcgtttcactcgcatgcagtcatctggagggactgaagcactgtttgcctttctgtacactctgggttttatattctcatttcatgcctaatgtcttattctgtcaattatggatatgttgaggtttaaaaaaattacttgattaaaaataaaacatataacgttggcatttaaaaaaaaaaaaaaaaaaaaaaaaaaaaaaaaaaaa

SEQ ID NO: 66 - protein, 204 aa, homo sapiens
MGAPLAVALGALHYLALFLQLGGATRPAGHAPWDNHVSGHALFTETPHDMTARTGEDVEMACSFRGSGSPSYSLEIQWWYVRSHRDWTDKQAWASNQLKASQQEDAGKEATKISVVKVVGSNISHKLRLSRVKPTDEGTYECRVIDFSDGKARHHKVKAYLRVQPGENSVLHLPEAPPAAPAPPPPKPGKELRKRSVDQEACSL

SEQ ID NO: 67 - protein, 193 aa, homo sapiens
MDGGTLPRSAPPAPPVPVGCAARRRPASPELLRCSRRRRPATAETGGGAAAVARRNERERNRVKLVNLGFQALRQHVPHGGASKKLSKVETLRSAVEYIRALQRLLAEHDAVRNALAGGLRPQAVRPSAPRGPPGTTPVAASPSRASSSPGRGGSSEPGSPRSAYSSDDSGCEGALSPAERELLDFSSWLGGY

SEQ ID NO: 68 - protein, 354 aa, homo sapiens
MRRLMSSRDWPRTRTGTGILSSQPEENPYWWNANMVFIPYCSSDVWSGASSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGIRYWNGVVPERCRRQFQEGEEWNCFFGYKVYPTLRCPVFVVQWLFDEAQLTVDNVHLTGQPVQEGLRLYIQNLGRELRHTLKDVPASFAPACLSHEIIIRSHWTDVQVKGTSLPRALHCWDRSLHDSHKASKTPLKGCPVHLVDSCPWPHCNPSCPTVRDQFTGQEMNVAQFLMHMGFDMQTVAQPQGLEPSELLGMLSNGS

SEQ ID NO: 69 - protein, 362 aa, homo sapiens [sequence omitted]

SEQ ID NO: 70 - protein, 137 aa, homo sapiens
MPRPRAHRCVWTRVAASRTGAPRSTTASCSASGRCAWASVWRCECCGRRAAGAAASAWASRAWTPRACPCPACRPSCAPTWRSRARRGRPCCLRAARSLGTWSASGWTAAAASSPRSTPAAGSCCVRACPSAPRSGP

SEQ ID NO: 71 - protein, 426 aa, homo sapiens
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLVLLGKKKKKEEEGEGKKKGGGEGGAGADEEKEQSHRPFLMLQARQSEDHPHRRRRRGLECDGKVNICCKKQFFVSFKDIGWNDWIIAPSGYHANYCEGECPSHIAGTSGSSLSFHSTVINHYRMRGHSPFANLKSCCVPTKLRPMSMLYYDDGQNIIKKDIQNMIVEECGCS

SEQ ID NO: 72 - protein, 868 aa, homo sapiens
MASFPETDFQICLLCKEMCGSPAPLSSNSSASSSSSQTSTSSGGGGGGPGAAARRLHVLPCLHAFCRPCLEAHRLPAAGGGAAGEPLKLRCPVCDQKVVLAEAAGMDALPSSAFLLNNLLDAVVATADEPPPKNGRAGAPAGAGGHSNHRHHAHHAHPRASASAPPLPQAPQPPAPSRSAPGGPAASPSALLLRRPHGCSSCDEGNAASSRCLDCQEHLCDNCVRAHQRVRLTKDHYIERGPPGPGAAAAAQQLGLGPPFPGPPFSILSVFPERLGFCQHHDDEVLHLYCDTCSVPICRECTMGRHGGHSFIYLQEALQDSRALTIQLLADAQQGRQAIQLSIEQAQTVAEQVEMKAKVVQSEVKAVTARHKKALEERECELLWKVEKIRQVKAKSLYLQVEKLRQNLNKLESTISAVQQVLEEGRALDILLARDRMLAQVQELKTVRSLLQPQEDDRVMFTPPDQALYLAIKSFGFVSSGAFAPLTKATGDGLKRALQGKVASFTVIGYDHDGEPRLSGGDLMSAVVLGPDGNLFGAEVSDQQNGTYVVSYRPQLEGEHLVSVTLCNQHIENSPFKVVVKSGRSYVGIGLPGLSFGSEGDSDGKLCRPWGVSVDKEGYIIVADRSNNRIQVFKPCGAFHHKFGTLGSRPGQFDRPAGVACDASRRIVVADKDNHRIQIFTFEGQFLLKFGEKGTKNGQFNYPWDVAVNSEGKILVSDTRNHRIQLFGPDGVFLNKYGFEGALWKHFDSPRGVAFNHEGHLVVTDFNNHRLLVIHPDCQSARFLGSEGTGNGQFLRPQGVAVDQEGRIIVADSRNHRVQMFESNGSFLCKFGAQGSGFGQMDRPSGIAITPDGMIVVVDFGNNRILVF

SEQ ID NO: 73 - protein, 3477 aa, homo sapiens
MANRRVGRGCWEVSPTERRPPAGLRGPAAEEEASSPPVLSLSHFCRSPFLCFGDVLLGASRTLSLALDNPNEEVAEVKISHFPAADLGFSVSQRCFVLQPKEKIVISVNWTPLKEGRVREIMTFLVNDVLKHQAILLGNAEEQKKKKRSLWDTIKKKKISASTSHNRRVSNIQNVNKTFSVSQKVDRVRSPLQACENLAMNEGGPPTENNSLILEENKIPISPISPAFNECHGATCLPLSVRRSTTYSSLHASENRELLNVHSANVSKVSFNEKAVTETSFNSVNVNGQRGENSKLSLTPNCSSTLNITQSQIHFLSPDSFVNNSHGANNELELVTCLSSDMFMKDNSQPVHLESTIAHEIYQKILSPDSFIKDNYGLNQDLESESVNPILSPNQFLKDNMAYMCTSQQTCKVPLSNENSQVPQSPEDWRKSEVSPRIPECQGSKSPKAIFEELVEMKSNYYSFIKQNNPKFSAVQDISSHSHNKQPKRRPILSATVTKRKATCTRENQTEINKPKAKRCLNSAVGEHEKVINNQKEKEDFHSYLPIIDPILSKSKSYKNEVTPSSTTASVARKRKSDGSMEDANVRVAITEHTEVREIKRIHFSPSEPKTSAVKKTKNVTTPISKRISNREKLNLKKKTDLSIFRTPISKTNKRTKPIIAVAQSSLTFIKPLKTDIPRHPMPFAAKNMFYDERWKEKQEQGFTWWLNFILTPDDFTVKTNISEVNAATLLLGIENQHKISVPRAPTKEEMSLRAYTARCRLNRLRRAACRLFTSEKMVKAIKKLEIEIEARRLIVRKDRHLWKDVGERQKVLNWLLSYNPLWLRIGLETTYGELISLEDNSDVTGLAMFILNRLLWNPDIAAEYRHPTVPHLYRDGHEEALSKFTLKKLLLLVCFLDYAKISRLIDHDPCLFCKDAEFKASKEILLAFSRDFLSGEGDLSRHLGLLGLPVNHVQTPFDEFDFAVTNLAVDLQCGVRLVRTMELLTQNWDLSKKLRIPAISRLQKMHNVDIVLQVLKSRGIELSDEHGNTILSKDIVDRHREKTLRLLWKIAFAFQVDISLNLDQLKEEIAFLKHTKSIKKTISLLSCHSDDLINKKKGKRDSGSFEQYSENIKLLMDWVNAVCAFYNKKVENFTVSFSDGRVLCYLIHHYHPCYVPFDAICQRTTQTVECTQTGSVVLNSSSESDDSSLDMSLKAFDHENTSELYKELLENEKKNFHLVRSAVRDLGGIPAMINHSDMSNTIPDEKVVITYLSFLCARLLDLRKEIRAARLIQTTWRKYKLKTDLKRHQEREKAARIIQLAVINFLAKQRLRKRVNAALVIQKYWRRVLAQRKLLMLKKEKLEKVQNKAASLIQGYWRRYSTRQRFLKLKYYSIILQSRIRMIIAVTSYKRYLWATVTIQRHWRAYLRRKQDQQRYEMLKSSTLIIQSMFRKWKQRKMQSQVKATVILQRAFREWHLRKQAKEENSAIIIQSWYRMHKELRKYIYIRSCVVIIQKRFRCFQAQKLYKRRKESILTIQKYYKAYLKGKIERTNYLQKRAAAIQLQAAFRRLKAHNLCRQIRAACVIQSYWRMRQDRVRFLNLKKTIIKFQAHVRKHQQRQKYKKMKKAAVIIQTHFRAYIFAMKVLASYQKTRSAVIVLQSAYRGMQARKMYIHILTSVIKIQSYYRAYVSKKEFLSLKNATIKLQSTVKMKQTRKQYLHLRAAALFIQQCYRSKKIAAQKREEYMQMRESCIKLQAFVRGYLVRKQMRLQRKAVISLQSYFRMRKARQYYLKMYKAIIVIQNYYHAYKAQVNQRKNFLQVKKAATCLQAAYRGYKVRQLIKQQSIAALKIQSAFRGYNKRVKYQSVLQSIIKIQRWYRAYKTLHDTRTHFLKTKAAVISLQSAYRGWKVRKQIRREHQAALKIQSAFRMAKAQKQFRLFKTAALVIQQNFRAWTAGRKQCMEYIELRHAVLVLQSMWKGKTLRRQLQRQHKCAIIIQSYYRMHVQQKKWKIMKKAALLIQKYYRAYSIGREQNHLYLKTKAAVVTLQSAYRGMKVRKRIKDCNKAAVTIQSKYRAYKTKKKYATYRASAIIIQRWYRGIKITNHQHKEYLNLKKTAIKIQSVYRGIRVRRHIQHMHRAATFIKAMFKMHQSRISYHTMRKAAIVIQVRCRAYYQGKMQREKYLTILKAVKVLQASFRGVRVRRTLRKMQTAATLIQSNYRRYRQQTYFNKLKKITKTVQQRYWAMKERNIQFQRYNKLRHSVIYIQAIFRGKKARRHLKMMHIAATLIQRRFRTLMMRRRFLSLKKTAILIQRKYRAHLCTKHHLQFLQVQNAVIKIQSSYRRWMIRKRMREMHRAATFIQSTFRMHRLHMRYRALKQASVVIQQQYQANRAAKLQRQHYLRQRHSAVILQAAFRGMKTRRHLKSMHSSATLIQSRFRSLLVRRRFISLKKATIFVQRKYRATICAKHKLYQFLHLRKAAITIQSSYRRLMVKKKLQEMQRAAVLIQATFRMHRTYITFQTWKHASILIQQHYRTYRAAKLQRENYIRQWHSAVVIQAAYKGMKARQLLREKHKASIVIQSTYRMYRQYCFYQKLQWATKIIQEKYRANKKKQKVFQHNELKKETCVQAGFQDMNIKKQIQEQHQAAIIIQKHCKAFKIRKHYLHLRATVVSIQRRYRKLTAVRTQAVICIQSYYRGFKVRKDIQNMHRAATLIQSFYRMHRAKVDYETKKTAIVVIQNYYRLYVRVKTERKNFLAVQKSVRTIQAAFRGMKVRQKLKNVSEEKMAAIVNQSALCCYRSKTQYEAVQSEGVMIQEWYKASGLACSQEAEYHSQSRAAVTIQKAFCRMVTRKLETQKCAALRIQFFLQMAVYRRRFVQQKRAAITLQHYFRTWQTRKQFLLYRKAAVVLQNHYRAFLSAKHQRQVYLQIRSSVIIIQARSKGFIQKRKFQEIKNSTIKIQAMWRRYRAKKYLCKVKAACKIQAWYRCWRAHKEYLAILKAVKIIQGCFYTKLERTRFLNVRASAIIIQRKWRAILPAKIAHEHFLMIKRHRAACLIQAHYRGYKGRQVFLRQKSAALIIQKYIRAREAGKHERIKYIEFKKSTVILQALVRGWLVRKRFLEQRAKIRLLHFTAAAYYHLNAVRIQRAYKLYLAVKNANKQVNSVICIQRWFRARLQEKRFIQKYHSIKKIEHEGQECLSQRNRAASVIQKAVRHFLLRKKQEKFTSGIIKIQALWRGYSWRKKNDCTKIKAIRLSLQVVNREIREENKLYKRTALALHYLLTYKHLSAILEALKHLEVVTRLSPLCCENMAQSGAISKIFVLIRSCNRSIPCMEVIRYAVQVLLNVSKYEKTTSAVYDVENCIDILLELLQIYREKPGNKVADKGGSIFTKTCCLLAILLKTTNRASDVRSRSKVVDRIYSLYKLTAHKHKMNTERILYKQKKNSSISIPFIPETPVRTRIVSRLKPDWVLRRDNMEEITNPLQAIQMVMDTLGIPY

SEQ ID NO: 74 - protein, 398 aa, homo sapiens
MAAVAVLRNDSLQAFLQDRTPSASPDLGKHSPLALLAATCSRIGQPGAAAPPDFLQVPYDPALGSPSRLFHPWTADMPAHSPGALPPPHPSLGLTPQKTHLQPSFGAAHELPLTPPADPSYPYEFSPVKMLPSSMAALPASCAPAYVPYAAQAALPPGYSNLLPPPPPPPPPPTCRQLSPNPAPDDLPWWSIPQAGAGPGASGVPGSGLSGACAGAPHAPRFPASAAAAAAAAAALQRGLVLGPSDFAQYQSQIAALLQTKAPLAATARRCRRCRCPNCQAAGGAPEAEPGKKKQHVCHVPGCGKVYGKTSHLKAHLRWHTGERPFVCNWLFCGKSFTRSDELQRHLRTHTGEKRFACPECGKRFMRSDHLAKHVKTHQNKKLKVAEAGVKREDARDL

SEQ ID NO: 75 - protein, 514 aa, homo sapiens
MGKDFRYYFQHPWSRMIVAYLVIFFNFLIFAEDPVSHSQTEANVIVVGNCFSFVTNKYPRGVGWRILKVLLWLLAILTGLIAGKFLFHQRLFGQLLRLKMFREDHGSWMTMFFSTILFLFIFSHIYNTILLMDGNMGAYIITDYMGIRNESFMKLAAVGTWMGDFVTAWMVTDMMLQDKPYPDWGKSARAFWKKGNVRITLFWTVLFTLTSVVVLVITTDWISWDKLNRGFLPSDEVSRAFLASFILVFDLLIVMQDWEFPHFMGDVDVNLPGLHTPHMQFKIPFFQKIFKEEYRIHITGKWFNYGIIFLVLILDLNMWKNQIFYKPHEYGQYIGPGQKIYTVKDSESLKDLNRTKLSWEWRSNHTNPRTNKTYVEGDMFLHSRFIGASLDVKCLAFVPSLIAFVWFGFFIWFFGRFLKNEPRMENQDKTYTRMKRKSPSEHSKDMGITRENTQASVEDPLNDPSLVCIRSDFNEIVYKSSHLTSENLSSQLNESTSATEADQDPTTSKSTPTN

SEQ ID NO: 76 - protein, 316 aa, homo sapiens [sequence omitted]

SEQ ID NO: 77 - protein, 6307 aa, homo sapiens
MSVFLGPGMPSASLLVNLLSALLILFVFGETEIRFTGQTEFVVNETSTTVIRLIIERIGEPANVTAIVSLYGEDAGDFFDTYAAAFIPAGETNRTVYIAVCDDDLPGPDETFIFHLTLQKPSANVKLGWPRTVTVTILSNDNAFGIISFNMLPSIAVSEPKGRNESMPLTLIREKGTYGMVMVTFEVEGGPNPPDEDLSPVKGNITFPPGRATVIYNLAVLDDEVPENDEIFLIQLKSVEGGAEINTSRNSIEIIIEKNDSPVRFLQSIYLVPEEDHILIIPVVRGKDNNGNLIGSDEYEVSISYAVTTGNSTAHAQQNLDFIDLQPNTTVVFPPFIHESHLKFQIVDDTIPEIAESFHIMLLKDTLQGDAVLISPSVVQVTIKPNDKPYGVLSFNSVLFERTVIIDEDRISRYEEITVVRNGGTHGNVSANWVVTPNSTDPSPVTADIRPSSGVLHFAQGQMLATIPLTGGDDDLPEEAEAYLLQILPHTIRGGAEVSEPAELLFYIQDSDDVYGLITFFPMENQKIESSPGGRYLSLSFTRLGGTKGDVRLLYSVLYIPAGAVDPLQAKEGILNISRRNDLIFPEQKTQVTTKLPIRNDAFLQNGAHFLVQLETVELLNIIPLIPPISPRFGEICNISLLVTPAIANGEIGFLSNLPIILHEPEDFAAEVVYIPLHRDGTDGQATVYWSLKPSGFNSKAVTPDDIGPFNGSVLFLSGQSDTTINITIKGDDIPEMNETVTLSLDWVNVENQVLKSGYTSRDLIILENDDPGGVFEFSPASRGPYVIKEGESVELHIIRSRGSLVKQFLHYRVEPRDSNEFYGNTGVLEFKPGEREIVITLLARLDGIPELDEHYWVVLSSHGERESKLGSATIVNITILKNDDPHGIIEFVSDGLIVMINESKGDAIYSAVYDVVRNRGNFGDVSVSWVVSPDFTQDVFPVQGTVVFGDQEFSKNITIYSLPDEIPEEMEEFTVILLNGTGGAKVGNRTTATLRIRRNDDPIYFAEPRVVRVQEGETANFTVLRNGSVDVTCMVQYATKDGKATARERDFIPVEKGETLIFEVGSRQQSISIFVNEDGIPETDEPFYIILLNSPGDPVVYQYGVATVIIEANDDPNGIFSLEPIDKAVEEGKTNAFWILRHRGYFGSVSVSWQLFQNDSALQPGQEFYETSGTVNFMDGEEAKPIILHAFPDKIPEFNEFYFLKLVNISGGSPGPGGQLAETNLQVTVMAPFNDDPFGVFILDPECLEREVAEDVLSEDDMSYITNFTILRQQGVFGDVQLGWEILSSEFPAGLPPMIDFLLVGIFPTTVHLQQHMRGHHSGTDALYFTGLEGAFGTGNSKYHPFRNNTIANFTFSAWVMPNANTNGFIIAKDDGNGSIYYGVKIQTNESHVTLSLHYKTLGSNATYIAKTTVMKYLEESVWLHLLIILEDGIIEFYLDGNAMPRGIKSLKGEAITDGPGILRIGAGINGNDRFTGLMQDVRSYERKLTLEEIYELHAMPAKSDLHPISGYLEFRQGETNKSFIISARDDNDEEGEELFILKLVSVYGGARISEENTTARLTIQKSDNANGLFGFTGACIPEIAEEGSTISCVVERTRGALDYVHVFYTISQIETDGINYLVDDFANASGTITFLPWQRSEVLNIYVLDDDIPELNEYFRVTLVSAIPGDGKLGSTPTSGASIDPEKETTDITIKASDHPYGLLQFSTGLPPQPKDAMTLPASSVPHITVEEEDGEIRLLVIRAQGLLGRVTAEFRTVSLTAFSPEDYQNVAGTLEFQPGERYKYIFINITDNSIPELEKSFKVELLNLEGGVAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGNVTFAPGETIQTLLLEVLADDVPEIEEVIQVQLTDASGGGTIGLDRIANIIIPANDDPYGTVAFAQMVYRVQEPLERSSCANITVRRSGGHFGRLLLFYSTSDIDVVALAMEEGQDLLSYYESPIQGVPDPLWRTWMNVSAVGEPLYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGEILQFHVIRTFPGRGNVTVNWKIIGQNLELNFANFSGQLFFPEGSLNTTLFVHLLDDNIPEEKEVYQVILYDVRTQGVPPAGIALLDAQGYAAVLTVEASDEPHGVLNFALSSRFVLLQEANITIQLFINREFGSLGAINVTYTTVPGMLSLKNQTVGNLAEPEVDFVPIIGFLILEEGETAAAINITILEDDVPELEEYFLVNLTYVGLTMAASTSFPPRLDSEGLTAQVIIDANDGARGVIEWQQSRFEVNETHGSLTLVAQRSREPLGHVSLFVYAQNLEAQVGLDYIFTPMILHFADGERYKNVNIMILDDDIPEGDEKFQLILTNPSPGLELGKNTIALIIVLANDDGPGVLSFNNSEHFFLREPTALYVQESVAVLYIVREPAQGLFGTVTVQFIVTEVNSSNESKDLTPSKGYIVLEEGVRFKALQISAILDTEPEMDEYFVCTLFNPTGGARLGVHVQTLITVLQNQAPLGLFSISAVENRATSIDIEEANRTVYLNVSRTNDIDLAVSVQWETVSETAFGMRGMDVVFSVFQSFLDESASGWCFFTLENLIYGIMLRKSSVTVYRWQGIFIPVEDLNIENPKTCEAFNIGFSPYFVITHEERNEEKPSLNSVFTFTSGFKLFLVQTIIILESSQVRYFTSDSQDYLIIASQRDDSELTQVFRWNGGSFVLHQKLPVRGVLTVALFNKGGSVFLAISQANARLNSLLFRWSGSGFINFQEVPVSGTTEVEALSSANDIYLIFAENVFLGDQNSIDIFIWEMGQSSFRYFQSVDFAAVNRIHSFTPASGIAHILLIGPRYVYSFTAGNSERNQFSFVLEVPSAYDVVSVTVKSLNSSKNLIALVGAHSHIYELAYISSHSDFIPSSGELIFEPGEREATIAVNILDDTVPEKEESFKVQLKNPKGGAEIGINDSVTITILSNDDAYGIVAFAQNSLYKQVEEMEQDSLVTLNVERLKGTYGRITIAWEADGSISDIFPTSGVILFTEGQVLSTITLTILADNIPELSEVVIVTLTRITTEGVEDSYKGATIDQDRSKSVITTLPNDSPFGLVGWRAASVFIRVAEPKENTTTLQLQIARDKGLLGDIAIHLRAQPNFLLHVDNQATENEDYVLQETIIIMKENIKEAHAEVSILPDDLPELEEGFIVTITEVNLVNSDFSTGQPSVRRPGMEIAEIMIEENDDPRGIFMFHVTRGAGEVITAYEVPPPLNVLQVPVVRLAGSFGAVNVYWKASPDSAGLEDFKPSHGILEFADKQVTAMIEITIIDDAEFELTETFNISLISVAGGGRLGDDVVVTVVIPQNDSPFGVFGFEEKTVMIDESLSSDDPDSYVTLTVVRSPGGKGTVRLEWTIDEKAKHNLSPLNGTLHFDETESQKTIVLHTLQDTVLEEDRRFTIQLISIDEVEISPVKGSASIIIRGDKRASGEVGIAPSSRHILIGEPSAKYNGTAIISLVRGPGILGEVTVFWRIFPPSVGEFAETSGKLTMRDEQSAVIVVIQALNDDIPEEKSFYEFQLTAVSGGGVLSESSSTANITVVASDSPYGRFAFSHEQLRVSEAQRVNITIIRSSGDFGHVRLWYKTMSGTAEAGLDFVPAAGELLFEAGEMRKSLHVEILDDDYPEGPEEFSLTITKVELQGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEGKDDTGFAAFAMVIITGSDLHNGIIGFSEESQSGLELREGAVMRRLHLIVTRQPNRAFEDVKVFWRVTLNKTVVVLQKDGVNLMEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVIEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 78 - protein, 465 aa, homo sapiens
MHLLVCVFGMGSWVTINGLWVELPLLVMELPEGWYLPSYLTVVIQLANIGPLLVTLLHHFRPSCLSEVPIIFTLLGVGTVTCIIFAFLWNMTSWVLDGHHSIAFLVLTFFLALVDCTSSVTFLPFMSRLPTYYLTTFFVGEGLSGLLPALVALAQGSGLTTCVNVTEISDSVPSPVPTRETDIAQGVPRALVSALPGMEAPLSHLESRYLPAHFSPLVFFLLLSIMMACCLVAFFVLQRQPRCWEASVEDLLNDQVTLHSIRLREENDLGPAGMVDSSQGQGYLEEKAAPCCPAHLAFVYTLVAFVNALTNGMLPSVQTYSCLSYGPVAYHLAATLSIVANPLASLVSMFLPNRSLLFLGVLSVLGTCFGGYNMAMAVMSPCPLLQGHWGGEVLIVASWVLFSGCLSYVKVMLGVVLRDLSRSALLWCGAAVQLGSLLGALLMFPLVNVLRLFSSADFCNLHCPA

SEQ ID NO: 79 - protein, 458 aa, homo sapiens
MAGSPSRAAGRRLQLPLLCLFLQGATAVLFAVFVRYNHKTDAALWHRSNHSNADNEFYFRYPSFQDVHAMVFVGFGFLMVFLQRYGFSSVGFTFLLAAFALQWSTLVQGFLHSFHGGHIHVGVESMINADFCAGAVLISFGAVLGKTGPTQLLLMALLEVVLFGINEFVLLHLLGVRDAGGSMTIHTFGAYFGLVLSRVLYRPQLEKSKHRQGSVYHSDLFAMIGTIFLWIFWPSFNAALTALGAGQHRTALNTYYSLAASTLGTFALSALVGEDGRLDMVHIQNAALAGGVVVGTSSEMMLTPFGALAAGFLAGTVSTLGYKFFTPILESKFKVQDTCGVHNLHGMPGVLGALLGVLVAGLATHEAYGDGLESVFPLIAEGQRSATSQAMHQLFGLFVTLMFASVGGGLGGLLLKLPFLDSPPDSQHYEDQVHWQVPGEHEDKAQRPLRVEEADTQA

SEQ ID NO: 80 - protein, 871 aa, homo sapiens
MIKKFDKKDEESGSGSNPFQHLEKSAVLQEARIFNETPINPRRCLHILTKILYLLNQGEHFGTTEATEAFFAMTRLFQSNDQTLRRMCYLTIKEMATISEDVIIVTSSLTKDMTGKEDVYRGPAIRALCRITDGTMLQAIERYMKQAIVDKVSSVSSSALVSSLHMMKISYDVVKRWINEAQEAASSDNIMVQYHALGVLYHLRKNDRLAVSKMLNKFTKSGLKSQFAYCMLIRIASRLLKETEDGHESPLFDFIESCLRNKHEMVIYEAASAIIHLPNCTARELAPAVSVLQLFCSSPKPALRYAAVRTLNKVAMKHPSAVTACNLDLENLITDSNRSIATLAITTLLKTGSESSVDRLMKQISSFVSEISDEFKVVVVQAISALCQKYPRKHSVMMTFLSNMLRDDGGFEYKRAIVDCIISIVEENPESKEAGLAHLCEFIEDCEHTVLATKILHLLGKEGPRTPVPSKYIRFIFNRVVLENEAVRAAAVSALAKFGAQNESLLPSILVLLQRCMMDTDDEVRDRATFYLNVLQQRQMALNATYIFNGLTVSVPGMEKALHQYTLEPSEKPFDMKSIPLAMAPVFEQKAEITLVATKPEKLAPSRQDIFQEQLAAIPEFLNIGPLFKSSEPVQLTEAETEYFVRCIKHMFTNHIVFQFDCTNTLNDQLLEKVTVQMEPSDSYEVLSCIPAPSLPYNQPGICYTLVRLPDDDPTAVAGSFSCTMKFTVRDCDPNTGVPDEDGYDDEYVLEDLEVTVSDHIQKVLKPNFAAAWEEVGDTFEKEETFALSSTKTLEEAVNNIITFLGMQPCERSDKVPENKNSHSLYLAGIFRGGYDLLVRSRLALADGVTMQVTVRSKERTPVDVILASVG

SEQ ID NO: 81 - protein, 250 aa, homo sapiens
MAEGGASKGGGEEPGKLPEPAEEESQVLRGTGHCKWFNVRMGFGFISMINREGSPLDIPVDVFVHQSKLFMEGFRSLKEGEPVEFTFKKSSKGLESIRVTGPGGSPCLGSERRPKGKTLQKRKPKGDRCYNCGGLDHHAKECSLPPQPKKCHYCQSIMHMVANCPHKNVAQPPASSQGRQEAESQPCTSTLPREVGGGHGCTSPPFPQEARAEISERSGRSPQEASSTKSSIAPEEQSKKGPSVQKRKKT

SEQ ID NO: 82 - protein, 210 aa, homo sapiens
MGFGFISMINREGSPLDIPVDVFVHQSKLFMEGFRSLKEGEPVEFTFKKSSKGLESIRVTGPGGSPCLGSERRPKGKTLQKRKPKGDRCYNCGGLDHHAKECSLPPQPKKCHYCQSIMHMVANCPHKNVAQPPASSQGRQEAESQPCTSTLPREVGGGHGCTSPPFPQEARAEISERSGRSPQEASSTKSSIAPEEQSKKGPSVQKRKKT

SEQ ID NO: 83 - protein, 391 aa, homo sapiens
MRQLCRGRVLGISVAIAHGVFSGSLNILLKFLISRYQFSFLTLVQCLTSSTAALSLELLRRLGLIAVPPFGLSLARSFAGVAVLSTLQSSLTLWSLRGLSLPMYVVFKRCLPLVTMLIGVLVLKNGAPSPGVLAAVLITTCGAALAGAGDLTGDPIGYVTGVLAVLVHAAYLVLIQKASADTEHGPLTAQYVIAVSATPLLVICSFASTDSIHAWTFPGWKDPAMVCIFVACILIGCAMNFTTLHCTYINSAVTTSLFIAGVVVNTLGSIIYCVAKFMETRKQSNYEDLEAQPRGEEAQLSGDQLPFVMEELPGEGGNGRSEGGEAAGGPAQESRQEVRGSPRGVPLVAGSSEEGSRRSLKDAYLEVWRLVRGTRYMKKDYLIENEELPSP

SEQ ID NO: 84 - protein, 907 aa, homo sapiens
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 85 - protein, 982 aa, homo sapiens
MPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYGLVGAGVVLMLIILVALLMLVFRSKREVKRQKYRLSQLYKWQEEDSGPAPGTFQNIGFDICQDDDSIHLESIYSNFQPSLRHIDPETKRSEFRGLR

SEQ ID NO: 86 - protein, 987 aa, homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 87 - protein, 445 aa, homo sapiens
MAAPTPARPVLTHLLVALFGMGSWAAVNGIWVELPVVVKELPEGWSLPSYVSVLVALGNLGLLVVTLWRRLAPGKDEQVPIRVVQVLGMVGTALLASLWHHVAPVAGQLHSVAFLALAFVLALACCASNVTFLPFLSHLPPRFLRSFFLGQGLSALLPCVLALVQGVGRLECPPAPINGTPGPPLDFLERFPASTFFWALTALLVASAAAFQGLLLLLPPPPSVPTGELGSGLQVGAPGAEEEVEESSPLQEPPSQAAGTTPGPDPKAYQLLSARSACLLGLLAATNALTNGVLPAVQSFSCLPYGRLAYHLAVVLGSAANPLACFLAMGVLCRSLAGLGGLSLLGVFCGGYLMALAVLSPCPPLVGTSAGVVLVVLSWVLCLGVFSYVKVAASSLLHGGGRPALLAAGVAIQVGSLLGAVAMFPPTSIYHVFHSRKDCADPCDS

SEQ ID NO: 88 - protein, 459 aa, homo sapiens
MDEKSNKLLLALVMLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSQNPNPNANQNLTQNLMQNLTQSLSQKENRESPKQNSGKEQNDNTSNGTNDYIGSVEKWR

SEQ ID NO: 89 - protein, 798 aa, homo sapiens
MEAGEGKERVPKQRQVLIFFVLLGIAQASCQPRHYSVAEETESGSFVANLLKDLGLEIGELAVRGARVVSKGKKMHLQFDRQTGDLLLNEKLDREELCGPTEPCVLPFQVLLENPLQFFQAELRIRDVNDHSPVFLDKEILLKIPESITPGTTFLIERAQDLDVGTNSLQNYTISPNFHFHLNLQDSLDGIILPQLVLNRALDREEQPEIRLTLTALDGGSPPRSGTALVRIEVVDINDNVPEFAKLLYEVQIPEDSPVGSQVAIVSARDLDIGTNGEISYAFSQASEDIRKTFRLSAKSGELLLRQKLDFESIQTYTVNIQATDGGGLSGTCVVFVQVMDLNDNPPELTMSTLINQIPENLQDTLIAVFSVSDPDSGDNGRMVCSIQDDLPFFLKPSVENFYTLVISTALDRETRSEYNITITVTDFGTPRLKTEHNITVLVSDVNDNAPAFTQTSYTLFVRENNSPALHIGSVSATDRDSGTNAQVTYSLLPPQDPHLPLASLVSINADNGHLFALQSLDYEALQAFEFRVGAADRGSPALSSEALVRVLVLDANDNSPFVLYPLQNGSAPCTELVPRAAEPGYLVTKVVAVDGDSGQNAWLSYQLLKATEPGLFGVWAHNGEVRTARLLRERDAAKQRLVVLVKDNGEPPRSATATLHVLLVDGFSQPYLLLPEAAPAQAQADLLTVYLVVALASVSSLFLFSVLLFVAVRLCRRSRAASVGRCSVPEGPFPGQMVDVSGTGTLSQSYQYEVCLTGGSGTNEFKFLKPIIPNFVAQGAERVSEANPSFRKSFEFT

SEQ ID NO: 90 - protein, 231 aa, homo sapiens
MMLSCLFLLKALLALGSLESWITAGEHAKEGECPPHKNPCKELCQGDELCPAEQKCCTTGCGRICRDIPKGRKRDCPRVIRKQSCLKRCITDETCPGVKKCCTLGCNKSCVVPISKQKLAEFGGECPADPLPCEELCDGDASCPQGHKCCSTGCGRTCLGDIEGGRGGDCPKVLVGLCIVGCVMDENCQAGEKCCKSGCGRFCVPPVLPPKLTMNPNWTVRSDSELEIPVP

SEQ ID NO: 91 - protein, 677 aa, homo sapiens
MLSSTDFTFASWELVVRVDHPNEEQQKDVTLRVSGDLHVGGVMLKLVEQINISQDWSDFALWWEQKHCWLLKTHWTLDKYGVQADAKLLFTPQHKMLRLRLPNLKMVRLRVSFSAVVFKAVSDICKILNIRRSEELSLLKPSGDYFKKKKKKDKNNKEPIIEDILNLESSPTASGSSVSPGLYSKTMTPIYDPINGTPASSTMTWFSDSPLTEQNCSILAFSQPPQSPEALADMYQPRSLVDKAKLNAGWLDSSRSLMEQGIQEDEQLLLRFKYYSFFDLNPKYDAVRINQLYEQARWAILLEEIDCTEEEMLIFAALQYHISKLSLSAETQDFAGESEVDEIEAALSNLEVTLEGGKADSLLEDITDIPKLADNLKLFRPKKLLPKAFKQYWFIFKDTSIAYFKNKELEQGEPLEKLNLRGCEVVPDVNVAGRKFGIKLLIPVADGMNEMYLRCDHENQYAQWMAACMLASKGKTMADSSYQPEVLNILSFLRMKNRNSASQVASSLENMDMNPECFVSPRCAKKHKSKQLAARILEAHQNVAQMPLVEAKLRFIQAWQSLPEFGLTYYLVRFKGSKKDDILGVSYNRLIKIDAATGIPVTTWRFTNIKQWNVNWETRQVVIEFDQNVFTAFTCLSADCKIVHEYIGGYIFLSTRSKDQNETLDEDLFHKLTGGQD

SEQ ID NO: 92 - protein, 764 aa, homo sapiens
MLLFVLTCLLAVFPAISTKSPIFGPEEVNSVEGNSVSITCYYPPTSVNRHTRKYWCRQGARGGCITLISSEGYVSSKYAGRANLTNFPENGTFVVNIAQLSQDDSGRYKCGLGINSRGLSFDVSLEVSQGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDEGPSKAFVNCDENSRLVSLTLNLVTRADEGWYWCGVKQGHFYGETAAVYVAVEERKAAGSRDVSLAKADAAPDEKVLDSGFREIENKAIQDPRLFAEEKAVADTRDQADGSRASVDSGSSEEQGGSSRALVSTLVPLGLVLAVGAVAVGVARARHRKNVDRVSIRSYRTDISMSDFENSREFGANDNMGASSITQETSLGGKEEFVATTESTTETKEPKKAKRSSKEEAEMAYKDFLLQSSTVAAEAQDGPQEA

SEQ ID NO: 93 - protein, 694 aa, homo sapiens
MKHLKRWWSAGGGLLHLTLLLSLAGLRVDLDLYLLLPPPTLLQDELLFLGGPASSAYALSPFSASGGWGRAGHLHPKGRELDPAAPPEGQLLREVRALGVPFVPRTSVDAWLVHSVAAGSADEAHGLLGAAAASSTGGAGASVDGGSQAVQGGGGDPRAARSGPLDAGEEEKAPAEPTAQVPDAGGCASEENGVLREKHEAVDHSSQHEENEERVSAQKENSLQQNDDDENKIAEKPDWEAEKTTESRNERHLNGTDTSFSLEDLFQLLSSQPENSLEGISLGDIPLPGSISDGMNSSAHYHVNFSQAISQDVNLHEAILLCPNNTFRRDPTARTSQSQEPFLQLNSHTTNPEQTLPGTNLTGFLSPVDNHMRNLTSQDLLYDLDINIFDEINLMSLATEDNFDPIDVSQLFDEPDSDSGLSLDSSHNNTSVIKSNSSHSVCDEGAIGYCTDHESSSHHDLEGAVGGYYPEPSKLCHLDQSDSDFHGDLTFQHVFHNHTYHLQPTAPESTSEPFPWPGKSQKIRSRYLEDTDRNLSRDEQRAKALHIPFSVDEIVGMPVDSFNSMLSRYYLTDLQVSLIRDIRRRGKNKVAAQNCRKRKLDIILNLEDDVCNLQAKKETLKREQAQCNKAINIMKQKLHDLYHDIFSRLRDDQGRPVNPNHYALQCTHDGSILIVPKELVASGHKKETQKGKRK

SEQ ID NO: 94 - protein, 110 aa, homo sapiens
MWMGLIQLVEGVKRKDQGFLEKEFYHKTNIKMHCEFHACWPAFTVLGEAWRDQVDWSILLRDAGLVKMSRKPRASSPLSNNHPPTPKRFPRQLGREKGPIEEVPGTKGSP

SEQ ID NO: 95 - protein, 425 aa, homo sapiens
MASGQFVNKLQEEVICPICLDILQKPVTIDCGHNFCLKCITQIGETSCGFFKCPLCKTSVRRDAIRFNSLLRNLVEKIQALQASEVQSKRKEATCPRHQEMFHYFCEDDGKFLCFVCRESKDHKSHNVSLIEEAAQNYQGQIQEQIQVLQQKEKETVQVKAQGVHRVDVFTDQVEHEKQRILTEFELLHQVLEEEKNFLLSRIYWLGHEGTEAGKHYVASTEPQLNDLKKLVDSLKTKQNMPPRQLLEDIKVVLCRSEEFQFLNPTPVPLELEKKLSEAKSRHDSITGSLKKFKDQLQADRKKDENRFFKSMNKNDMKSWGLLQKNNHKMNKTSEPGSSSAGGRTTSGPPNHHSSAPSHSLFRASSAGKVTFPVCLLASYDEISGQGASSQDTKTFDVALSEELHAALSEWLTAIRAWFCEVPSS

SEQ ID NO: 96 - protein, 429 aa, homo sapiens
MTTDDTEVPAMTLAPGHAALETQTLSAETSSRASTPAGPIPEAETRGAKRISPARETRSFTKTSPNFMVLIATSVETSAASGSPEGAGMTTVQTITGSDPREAIFDTLCTDDISEEAKTLTMDILTLAHTSTEAKGLSSESSASSDGPHPVITPSRASESSASSDGLHPVITPSRASESSASSDGLHPVITPSRASESSASSDGPHPVITPSWSPGSDVTLLAEALVTVTNIEVINCSITEIETTTSSIPGASDTDLIPTEGVKASSTSDPPALPDSTNTKPHITEVTASAETLSTAGTTESAAPDATIGTPLPTNSTIEREVTAPGATTLSGALATGNPLEETSALSVETPSYVKVSGAAPVSIEAGSAVGKTTSFAGSSASSYSPLEAALKNFTPSETLTTDIATKGPFPTSRAPLPSVPPTTTNSS

SEQ ID NO: 97 - protein, 165 aa, homo sapiens
MAPNASCLCVHVRSEEWDLMTFDANPYDSVKKIKEHVRSKTKVPVQDQVLLLGSKILKPRRSLSSYGIDKEKTIHLTLKVVKPSDEELPLFLVESGDEAKRHLLQVRRSSSVAQVKAMIETKTGIIPETQIVTCNGKRLEDGKMMADYGIRKGNLLFLASYCIGG

SEQ ID NO: 98 - protein, 891 aa, homo sapiens
MHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 99 - protein, 292 aa, homo sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDDVPKLQPHPGLEKKEEEEEEEEYDEGSNLKKQTNKNRVQSGPRTPNPYASDNSSLMFPILVAFGVFIPTLFCLCRL

SEQ ID NO: 100 - protein, 963 aa, homo sapiens
MLHFHLLKFKTRVIFSAVIIMVTGLCLFLLSLPHLHGVFEQVPAPWWTSLCPWPIMEAAAFQSGSLYPVASFLAAPMSELVPDLSFQVDLHTGLSEFSVTQRRLAHGWNEFVADNSEPVWKKYLDQFKNPLILLLLGSALVSVLTKEYEDAVSIATAVLVVVTVAFIQEYRSEKSLEELTKLVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTSISALSLITLSTVFNLPSPLNAMQILWINIIMDGPPAQSLGVEPVDKDAFRQPPRSVRDTILSRALILKILMSAAIIISGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 101 - protein, 335 aa, homo sapiens
MVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 102 - protein, 992 aa, homo sapiens
MGAAGRQDFLFKAMLTISWLTLTCFPGATSTVAAGCPDQSPELQPWNPGHDQDHHVHIGQGKTLLLTSSATVYSIHISEGGKLVIKDHDEPIVLRTRHILIDNGGELHAGSALCPFQGNFTIILYGRADEGIQPDPYYGLKYIGVGKGGALELHGQKKLSWTFLNKTLHPGGMAEGGYFFERSWGHRGVIVHVIDPKSGTVIHSDRFDTYRSKKESERLVQYLNAVPDGRILSVAVNDEGSRNLDDMARKAMTKLGSKHFLHLGFRHPWSFLTVKGNPSSSVEDHIEYHGHRGSAAARVFKLFQTEHGEYFNVSLSSEWVQDVEWTEWFDHDKVSQTKGGEKISDLWKAHPGKICNRPIDIQATTMDGVNLSTEVVYKKGQDYRFACYDRGRACRSYRVRFLCGKPVRPKLTVTIDTNVNSTILNLEDNVQSWKPGDTLVIASTDYSMYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGGLDHSGRTLPIGQNFPIRGIQLYDGPINIQNCTFRKFVALEGRHTSALAFRLNNAWQSCPHNNVTGIAFEDVPITSRVFFGEPGPWFNQLDMDGDKTSVFHDVDGSVSEYPGSYLTKNDNWHSLASKAASGPSG

SEQ ID NO: 103 - protein, 296 aa, homo sapiens
MEHLKAFDDEINAFLDNMFGPRDSRVRGWFTLDSYLPTFFLTVMYLLSIWLGNKYMKNRPALSLRGILTLYNLGITLLSAYMLAELILSTWEGGYNLQCQDLTSAGEADIRVAKVLWWYYFSKSVEFLDTIFFVLRKKTSQITFLHVYHHASMFNIWWCVLNWIPCGQSFFGPTLNSFVHILMYSYYGLSVFPSMHKYLWWKKYLTQAQLVQFVLTITHTMSAVVKPCGFPFGCLIFQSSYMLTLVILFLNFYVQTYRKKPMKKDMQEPPAGKEVKNGFSKAYFTAANGVMNKKAQ

SEQ ID NO: 104 - protein, 1612 aa, homo sapiens
MIAEPAHFYLFGLICLCSGSRLRQEDFPPRIVEHPSDLIVSKGEPATLNCKAEGRPTPTIEWYKGGERVETDKDDPRSHRMLLPSGSLFFLRIVHGRKSRPDEGVYVCVARNYLGEAVSHNASLEVAILRDDFRQNPSDVMVAVGEPAVMECQPPRGHPEPTISWKKDGSPLDDKDERITIRGGKLMITYTRKSDAGKYVCVGTNMVGERESEVAELTVLERPSFVKRPSNLAVTVDDSAEFKCEARGDPVPTVRWRKDDGELPKSRYEIRDDHTLKIRKVTAGDMGSYTCVAENMVGKAEASATLTVQEPPHFVVKPRDQVVALGRTVTFQCEATGNPQPAIFWRREGSQNLLFSYQPPQSSSRFSVSQTGDLTITNVQRSDVGYYICQTLNVAGSIITKAYLEVTDVIADRPPPVIRQGPVNQTVAVDGTFVLSCVATGSPVPTILWRKDGVLVSTQDSRIKQLENGVLQIRYAKLGDTGRYTCIASTPSGEATWSAYIEVQEFGVPVQPPRPTDPNLIPSAPSKPEVTDVSRNTVTLSWQPNLNSGATPTSYIIEAFSHASGSSWQTVAENVKTETSAIKGLKPNAIYLFLVRAANAYGISDPSQISDPVKTQDVLPTSQGVDHKQVQRELGNAVLHLHNPTVLSSSSIEVHWTVDQQSQYIQGYKILYRPSGANHGESDWLVFEVRTPAKNSVVIPDLRKGVNYEIKARPFFNEFQGADSEIKFAKTLEEAPSAPPQGVTVSKNDGNGTAILVSWQPPPEDTQNGMVQEYKVWCLGNETRYHINKTVDGSTFSVVIPFLVPGIRYSVEVAASTGAGSGVKSEPQFIQLDAHGNPVSPEDQVSLAQQISDVVKQPAFIAGIGAACWIILMVFSIWLYRHRKKRNGLTSTYAGIRKVPSFTFTPTVTYQRGGEAVSSGGRPGLLNISEPAAQPWLADTWPNTGNNHNDCSISCCTAGNGNSDSNLTTYSRPADCIANYNNQLDNKQTNLMLPESTVYGDVDLSNKINEMKTFNSPNLKDGRFVNPSGQPTPYATTQLIQSNLSNNMNNGSGDSGEKHWKPLGQQKQEVAPVQYNIVEQNKLNKDYRANDTVPPTIPYNQSYDQNTGGSYNSSDRGSSTSGSQGHKKGARTPKVPKQGGMNWADLLPPPPAHPPPHSNSEEYNISVDESYDQEMPCPVPPARMYLQQDELEEEEDERGPTPPVRGAASSPAAVSYSHQSTATLTPSPQEELQPMLQDCPEETGHMQHQPDRRRQPVSPPPPPRPISPPHTYGYISGPLVSDMDTDAPEEEEDEADMEVAKMQTRRLLLRGLEQTPASSVGDLESSVTGSMINGWGSASEEDNISSGRSSVSSSDGSFFTDADFAQAVAAAAEYAGLKVARRQMQDAAGRRHFHASQCPRPTSPVSTDSNMSAAVMQKTRPAKKLKHQPGHLRRETYTDDLPPPPVPPPAIKSPTAQSKTQLEVRPVVVPKLPSMDARTDRSSDRKGSSYKGREVLDGRQVVDMRTNPGDPREAQEQQNDGKGRGNKAAKRDLPPAKTHLIQEDILPYCRPTFPTSNNPRDPSSSSSMSSRGSGSRQREQANVGRRNIAEMQVLGGYERGEDNNEELEETES

SEQ ID NO: 105 - protein, 570 aa, homo sapiens
MAGGAREVLTLQLGHFAGFVGAHWWNQQDAALGRATDSKEPPGELCPDVLYRTGRTLHGQETYTPRLILMDLKGSLSSLKEEGGLYRDKQLDAAIAWQGKLTTHKEELYPKNPYLQDFLSAEGVLSSDGVWRVKSIPNGKGSSPLPTATTPKPLIPTEASIRVWSDFLRVHLHPRSICMIQKYNHDGEAGRLEAFGQGESVLKEPKYQEELEDRLHFYVEECDYLQGFQILCDLHDGFSGVGAKAAELLQDEYSGRGIITWGLLPGPYHRGEAQRNIYRLLNTAFGLVHLTAHSSLVCPLSLGGSLGLRPEPPVSFPYLHYDATLPFHCSAILATALDTVTVPYRLCSSPVSMVHLADMLSFCGKKVVTAGAIIPFPLAPGQSLPDSLVQFGGATPWTPLSACGEPSGTRCFAQSVVLRGIDRACHTSQLTPGTPPPSALHACTTGEEILAQYLQQQQPGVMSSSHLLLTPCRVAPPYPHLFSSCSPPGMVLDGSPKGAAVESIPVFGALCSSSSLHQTLEALARDLTKLDLRRWASFMDAGVEHDDVAELLQELQSLAQCYQGGDSLVD

SEQ ID NO: 106 - protein, 141 aa, homo sapiens
MAQYLSTLLLLLATLAVALAWSPKEEDRIIPGGIYNADLNDEWVQRALHFAISEYNKATKDDYYRRPLRVLRARQQTVGGVNYFFDVEVGRTICTKSQPNLDTCAFHEQPELQKKQLCSFEIYEVPWENRRSLVKSRCQES

SEQ ID NO: 107 - protein, 247 aa, homo sapiens
MPRLLHPALPLLLGATLTFRALRRALCRLPLPVHVRADPLRTWRWHNLLVSFAHSIVSGIWALLCVWQTPDMLVEIETAWSLSGYLLVCFSAGYFIHDTVDIVASGQTRASWEYLVHHVMAMGAFFSGIFWSSFVGGGVLTLLVEVSNIFLTIRMMMKISNAQDHLLYRVNKYVNLVMYFLFRLAPQAYLTHFFLRYVNQRTLGTFLLGILLMLDVMIIIYFSRLLRSDFCPEHVPKKQHKDKFLTE

SEQ ID NO: 108 - protein, 158 aa, homo sapiens
MAARSVSGITRRVFMWTVSGTPCREFWSRFRKEKEPVVVETVEEKKEPILVCPPLRSRAYTPPEDLQSRLESYVKEVFGSSLPSNWQDISLEDSRLKFNLLAHLADDLGHVVPNSRLHQMCRVRDVLDFYNVPIQDRSKFDELSASNLPPNLKITWSY

SEQ ID NO: 109 - protein, 601 aa, homo sapiens
MRVVRLLRLRAALTLLGEVPRRPASRGVPGSRRTQKGSGARWEKEKHEDGVKWRQLEHKGPYFAPPYEPLPDGVRFFYEGRPVRLSVAAEEVATFYGRMLDHEYTTKEVFRKNFFNDWRKEMAVEEREVIKSLDKCDFTEIHRYFVDKAAARKVLSREEKQKLKEEAEKLQQEFGYCILDGHQEKIGNFKIEPPGLFRGRGDHPKMGMLKRRITPEDVVINCSRDSKIPEPPAGHQWKEVRSDNTVTWLAAWTESVQNSIKYIMLNPCSKLKGETAWQKFETARRLRGFVDEIRSQYRADWKSREMKTRQRAVALYFIDKLALRAGNEKEDGEAADTVGCCSLRVEHVQLHPEADGCQHVVEFDFLGKDCIRYYNRVPVEKPVYKNLQLFMENKDPRDDLFDRLTTTSLNKHLQELMDGLTAKVFRTYNASITLQEQLRALTRAEDSIAAKILSYNRANRVVAILCNHQRATPSTFEKSMQNLQTKIQAKKEQVAEARAELRRARAEHKAQGDGKSRSVLEKKRRLLEKLQEQLAQLSVQATDKEENKQVALGTSKLNYLDPRISIAWCKRFRVPVEKIYSKTQRERFAWALAMAGEDFEF

SEQ ID NO: 110 - protein, 269 aa, homo sapiens
MNQEDLDPDSTTDVGDVTNTEEELIRECEEMWKDMEECQNKLSLIGTETLTDSNAQLSLLIMQVKCLTAELSQWQKKTPETIPLTEDVLITLGKEEFQKLRQDLEMVLSTKESKNEKLKEDLEREQRWLDEQQQIMESLNVLHSELKNKVETFSESRIFNELKTKMLNIKEYKEKLLSTLGEFLEDHFPLPDRSVKKKKKNIQESSVNLITLHEMLEILINRLFDVPHDPYVKISDSFWPPYVELLLRNGIALRHPEDPTRIRLEAFHQ

SEQ ID NO: 111 - protein, 829 aa, homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 112 - protein, 926 aa, homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVKTLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 113 - protein, 220 aa, homo sapiens
MSMGLEITGTALAVLGWLGTIVCCALPMWRVSAFIGSNIITSQNIWEGLWMNCVVQSTGQMQCKVYDSLLALPQDLQAARALIVVAILLAAFGLLVALVGAQCTNCVQDDTAKAKITIVAGVLFLLAALLTLVPVSWSANTIIRDFYNPVVPEAQKREMGAGLYVGWAAAALQLLGGALLCCSCPPREKKYTATKVVYSAPRSTGPGASLGTGYDRKDYV

SEQ ID NO: 114 - protein, 209 aa, homo sapiens
MASMGLQVMGIALAVLGWLAVMLCCALPMWRVTAFIGSNIVTSQTIWEGLWMNCVVQSTGQMQCKVYDSLLALPQDLQAARALVIISIIVAALGVLLSVVGGKCTNCLEDESAKAKTMIVAGVVFLLAGLMVIVPVSWTAHNIIQDFYNPLVASGQKREMGASLYVGWAASGLLLLGGGLLCCNCPPRTDKPYSAKYSAARSAAASNYV

SEQ ID NO: 115 - protein, 346 aa, homo sapiens
MFLSILVALCLWLHLALGVRGAPCEAVRIPMCRHMPWNITRMPNHLHHSTQENAILAIEQYEELVDVNCSAVLRFFFCAMYAPICTLEFLHDPIKPCKSVCQRARDDCEPLMKMYNHSWPESLACDELPVYDRGVCISPEAIVTDLPEDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENCLVEKWRDQLSKRSIQWEERLQEQRRTVQDKKKTAGRTSRSNPPKPKGKPPAPKPASPKKNIKTRSAQKRTNPKRV

SEQ ID NO: 116 - protein, 553 aa, homo sapiens
MAAPAGGGGSAVSVLAPNGRRHTVKVTPSTVLLQVLEDTCRRQDFNPCEYDLKFQRSVLDLSLQWRFANLPNNAKLEMVPASRSREGPENMVRIALQLDDGSRLQDSFCSGQTLWELLSHFPQIRECLQHPGGATPVCVYTRDEVTGEAALRGTTLQSLGLTGGSATIRFVMKCYDPVGKTPGSLGSSASAGQAAASAPLPLESGELSRGDLSRPEDADTSGPCCEHTQEKQSTRAPAAAPFVPFSGGGQRLGGPPGPTRPLTSSSAKLPKSLSSPGGPSKPKKSKSGQDPQQEQEQERERDPQQEQERERPVDREPVDREPVVCHPDLEERLQAWPAELPDEFFELTVDDVRRRLAQLKSERKRLEEAPLVTKAFREAQIKEKLERYPKVALRVLFPDRYVLQGFFRPSETVGDLRDFVRSHLGNPELSFYLFITPPKTVLDDHTQTLFQANLFPAALVHLGAEEPAGVYLEPGLLEHAISPSAADVLVARYMSRAAGSPSPLPAPDPAPKSEPAAEEGALVPPEPIPGTAQPVKRSLGKVPKWLKLPASKR

SEQ ID NO: 117 - protein, 102 aa, homo sapiens
MSARVRSRSRGRGDGQEAPDVVAFVAPGESQQEEPPTDNQDIEPGQEREGTPPIEERKVEGDCQEMDLEKTRSERGDGSDVKEKTPPNPKHAKTKEAGDGQP

SEQ ID NO: 118 - protein, 724 aa, homo sapiens
MSFPKAPLKRFNDPSGCAPSPGAYDVKTLEVLKGPVSFQKSQRFKQQKESKQNLNVDKDTTLPASARKVKSSESKESQKNDKDLKILEKEIRVLLQERGAQDSRIQDLETELEKMEARLNAALREKTSLSANNATLEKQLIELTRTNELLKSKFSENGNQKNLRILSLELMKLRNKRETKMRGMMAKQEGMEMKLQVTQRSLEESQGKIAQLEGKLVSIEKEKIDEKSETEKLLEYIEEISCASDQVEKYKLDIAQLEENLKEKNDEILSLKQSLEENIVILSKQVEDLNVKCQLLEKEKEDHVNRNREHNENLNAEMQNLKQKFILEQQEREKLQQKELQIDSLLQQEKELSSSLHQKLCSFQEEMVKEKNLFEEELKQTLDELDKLQQKEEQAERLVKQLEEEAKSRAEELKLLEEKLKGKEAELEKSSAAHTQATLLLQEKYDSMVQSLEDVTAQFESYKALTASEIEDLKLENSSLQEKAAKAGKNAEDVQHQILATESSNQEYVRMLLDLQTKSALKETEIKEITVSFLQKITDLQNQLKQQEEDFRKQLEDEEGRKAEKENTTAELTEEINKWRLLYEELYNKTKPFQLQLDAFEVEKQALLNEHGAAQEQLNKIRDSYAKLLGHQNLKQKIKHVVKLKDENSQLKSEVSKLRCQLAKKKQSETKLQEELNKVLGIKHFDPSKAFHHESKENFALKTPLKEGNTNCYRAPMECQESWK

SEQ ID NO: 119 - protein, 325 aa, homo sapiens
MTERRRDELSEEINNLREKVMKQSEENNNLQSQVQKLTEENTTLREQVEPTPEDEDDDIELRGAAAAAAPPPPIEEECPEDLPEKFDGNPDMLAPFMAQCQIFMEKSTRDFSVDRVRVCFVTSMMTGRAARWASAKLERSHYLMHNYPAFMMEMKHVFEDPQRREVAKRKIRRLRQGMGSVIDYSNAFQMIAQDLDWNEPALIDQYHEGLSDHIQEELSHLEVAKSLSALIGQCIHIERRLARAAAARKPRSPPRALVLPHIASHHQVDPTEPVGGARMRLTQEEKERRRKLNLCLYCGTGGHYADNCPAKASKSSPAGNSPAPL

SEQ ID NO: 120 - protein, 162 aa, homo sapiens
MDIPQTKQDLELPKLAGTWHSMAMATNNISLMATLKAPLRVHITSLLPTPEDNLEIVLHRWENNSCVEKKVLGEKTGNPKKFKINYTVANEATLLDTDYDNFLFLCLQDTTTPIQSMMCQYLARVLVEDDEIMQGFIRAFRPLPRHLWYLLDLKQMEEPCRF

SEQ ID NO: 121 - protein, 55 aa, homo sapiens
MAKDTASLFIPLCGCSNSKSGTTGQMNVGTCRYGSLALRQLVWGLPPGASWPHLR

SEQ ID NO: 122 - protein, 384 aa, homo sapiens
MEGLGRSCLWLRRELSPPRPRLLLLDCRSRELYESARIGGALSVALPALLLRRLRRGSLSVRALLPGPPLQPPPPAPVLLYDQGGGRRRRGEAEAEAEEWEAESVLGTLLQKLREEGYLAYYLQGGFSRFQAECPHLCETSLAGRAGSSMAPVPGPVPVVGLGSLCLGSDCSDAESEADRDSMSCGLDSEGATPPPVGLRASFPVQILPNLYLGSARDSANLESLAKLGIRYILNVTPNLPNFFEKNGDFHYKQIPISDHWSQNLSRFFPEAIEFIDEALSQNCGVLVHCLAGVSRSVTVTVAYLMQKLHLSLNDAYDLVKRKKSNISPNFNFMGQLLDFERSLRLEERHSQEQGSGGQASAASNPPSFFTTPTSDGAFELAPT

SEQ ID NO: 123 - protein, 1016 aa, homo sapiens
MSQGPPTGESSEPEAKVLHTKRLYRAVVEAVHRLDLILCNKTAYQEVFKPENISLRNKLRELCVKLMFLHPVDYGRKAEELLWRKVYYEVIQLIKTNKKHIHSRSTLECAYRTHLVAGIGFYQHLLLYIQSHYQLELQCCIDWTHVTDPLIGCKKPVSASGKEMDWAQMACHRCLVYLGDLSRYQNELAGVDTELLAERFYYQALSVAPQIGMPFNQLGTLAGSKYYNVEAMYCYLRCIQSEVSFEGAYGNLKRLYDKAAKMYHQLKKCETRKLSPGKKRCKDIKRLLVNFMYLQSLLQPKSSSVDSELTSLCQSVLEDFNLCLFYLPSSPNLSLASEDEEEYESGYAFLPDLLIFQMVIICLMCVHSLERAGSKQYSAAIAFTLALFSHLVNHVNIRLQAELEEGENPVPAFQSDGTDEPESKEPVEKEEEPDPEPPPVTPQVGEGRKSRKFSRLSCLRRRRHPPKVGDDSDLSEGFESDSSHDSARASEGSDSGSDKSLEGGGTAFDAETDSEMNSQESRSDLEDMEEEEGTRSPTLEPPRGRSEAPDSLNGPLGPSEASIASNLQAMSTQMFQTKRCFRLAPTFSNLLLQPTTNPHTSASHRPCVNGDVDKPSEPASEEGSESEGSESSGRSCRNERSIQEKLQVLMAEGLLPAVKVFLDWLRTNPDLIIVCAQSSQSLWNRLSVLLNLLPAAGELQESGLALCPEVQDLLEGCELPDLPSSLLLPEDMALRNLPPLRAAHRRFNFDTDRPLLSTLEESVVRICCIRSFGHFIARLQGSILQFNPEVGIFVSIAQSEQESLLQQAQAQFRMAQEEARRNRLMRDMAQLRLQLEVSQLEGSLQQPKAQSAMSPYLVPDTQALCHHLPVIRQLATSGRFIVIIPRTVIDGLDLLKKEHPGARDGIRYLEAEFKKGNRYIRCQKEVGKSFERHKLKRQDADAWTLYKILDSCKQLTLAQGAGEEDPSGMVTIITGLPLDNPSVLSGPMQAALQAAAHASVDIKDVLDFYKQWKEIG

SEQ ID NO: 124 - DNA, 21 bp, homo sapiens
ggattctctgccctgtcacac

SEQ ID NO: 125 - DNA, 20 bp, homo sapiens
cttggcacaggacccaagag

SEQ ID NO: 126 - DNA, 23 bp, homo sapiens
cggaggggagaggattttctaag

SEQ ID NO: 127 - DNA, 24 bp, homo sapiens
ggtccaggtcatctttattacgcc

SEQ ID NO: 128 - DNA, 22 bp, homo sapiens
gggattaggaatatgggctctg

SEQ ID NO: 129 - DNA, 23 bp, homo sapiens
aatgaggaaactgaggcataaag

SEQ ID NO: 130 - DNA, 22 bp, homo sapiens
catcacatcatttcacccccac

SEQ ID NO: 131 - DNA, 23 bp, homo sapiens
ccccttttttgtccagcttactc

SEQ ID NO: 132 - DNA, 22 bp, homo sapiens
atgtgcctgccactacctcatc

SEQ ID NO: 133 - DNA, 20 bp, homo sapiens
gccactgaaccaaaatcggg

SEQ ID NO: 134 - DNA, 20 bp, homo sapiens
actcgcacaggcacagggat

SEQ ID NO: 135 - DNA, 20 bp, homo sapiens
gccccgctccaaacatcact

SEQ ID NO: 136 - DNA, 23 bp, homo sapiens
ttctgcctgaagaagcgtcatac

SEQ ID NO: 137 - DNA, 24 bp, homo sapiens
gccatcctctctgtcaagtaccag

SEQ ID NO: 138 - DNA, 28 bp, homo sapiens
gcgcattttgagagaagttgggtactgg

SEQ ID NO: 139 - DNA, 24 bp, homo sapiens
gaattcgtggtggcatgcccttct

SEQ ID NO: 140 - DNA, 24 bp, homo sapiens
aacccctctttctgtccatgccag

SEQ ID NO: 141 - DNA, 24 bp, homo sapiens
tcttcaatacccaggaggtacagg

SEQ ID NO: 142 - DNA, 22 bp, homo sapiens
gcagtcttggatgatgggttcc

SEQ ID NO: 143 - DNA, 24 bp, homo sapiens
aaggagttagcagcagcctagttg

SEQ ID NO: 144 - DNA, 20 bp, homo sapiens
tttctatggcattccagcgg

SEQ ID NO: 145 - DNA, 23 bp, homo sapiens
agaagctatcaggcgttgctgaa

SEQ ID NO: 146 - DNA, 22 bp, homo sapiens
cttcacctgctcattgcctgtc

SEQ ID NO: 147 - DNA, 21 bp, homo sapiens
tgccgtggtaatgtgaatccc

SEQ ID NO: 148 - DNA, 22 bp, homo sapiens
aacgacgaaaagagaaggaccc

SEQ ID NO: 149 - DNA, 23 bp, homo sapiens
ggaaagtgttagacgcagaaggc

SEQ ID NO: 150 - DNA, 24 bp, homo sapiens
aaagttgcagacaaaggcggaagc

SEQ ID NO: 151 - DNA, 25 bp, homo sapiens
tggacctacttcgtacatcagaggc

SEQ ID NO: 152 - DNA, 21 bp, homo sapiens
gacggtgggaacggtttagag

SEQ ID NO: 153 - DNA, 20 bp, homo sapiens
aggcttccaacttccgctgc

SEQ ID NO: 154 - DNA, 21 bp, homo sapiens
cacctgcatccatagcacagc

SEQ ID NO: 155 - DNA, 22 bp, homo sapiens
tcggaagggtgtgaaagaggac

SEQ ID NO: 156 - DNA, 25 bp, homo sapiens
cccttctttggtttgcatcaggtct

SEQ ID NO: 157 - DNA, 26 bp, homo sapiens
cgttgggtcttgatcagcttctgttg

SEQ ID NO: 158 - DNA, 20 bp, homo sapiens
tgtctgttgcatgcggttca

SEQ ID NO: 159 - DNA, 22 bp, homo sapiens
ccacggtgtagaagagcgatac

SEQ ID NO: 160 - DNA, 21 bp, homo sapiens
ggtcactgatagccgatgagg

SEQ ID NO: 161 - DNA, 20 bp, homo sapiens
ctcctgagctccacgatctg

SEQ ID NO: 162 - DNA, 25 bp, homo sapiens
gttggtctccatgttcctgcctaac

SEQ ID NO: 163 - DNA, 23 bp, homo sapiens
cagcatcaccttgacgtagctga

SEQ ID NO: 164 - DNA, 22 bp, homo sapiens
cgagcatgaggataaagcccag

SEQ ID NO: 165 - DNA, 23 bp, homo sapiens
gtagcagccagtcagcatcttcg

SEQ ID NO: 166 - DNA, 20 bp, homo sapiens
tggcaatgaagcacccctct

SEQ ID NO: 167 - DNA, 23 bp, homo sapiens
ggtccacactgctctcacttcct

SEQ ID NO: 168 - DNA, 28 bp, homo sapiens
tcacatctatcaaccactggcacctacc

SEQ ID NO: 169 - DNA, 25 bp, homo sapiens
gggttcactttggtctctagtacgg

SEQ ID NO: 170 - DNA, 20 bp, homo sapiens
caagcaaatgcaatggctgg

SEQ ID NO: 171 - DNA, 24 bp, homo sapiens
ggatgtgcagtgaaacttgaaagg

SEQ ID NO: 172 - DNA, 25 bp, homo sapiens
gctgtgttctctctggataacccac

SEQ ID NO: 173 - DNA, 25 bp, homo sapiens
gccatttggtttggatgtattgaag

SEQ ID NO: 174 - DNA, 24 bp, homo sapiens
ctgggaccttccaaaacattggct

SEQ ID NO: 175 - DNA, 25 bp, homo sapiens
cattacctgaggcctctgaattcgg

SEQ ID NO: 176 - DNA, 24 bp, homo sapiens
tccaggtacatatcacgcgcacag

SEQ ID NO: 177 - DNA, 25 bp, homo sapiens
ccagatgcaggatcaacccttctca

SEQ ID NO: 178 - DNA, 24 bp, homo sapiens
gtgctgtcgtgggtgctgtgtctt

SEQ ID NO: 179 - DNA, 22 bp, homo sapiens
cacgtgatagatgctggtcggg

SEQ ID NO: 180 - DNA, 23 bp, homo sapiens
cttgataatgtgggcaaaccctt

SEQ ID NO: 181 - DNA, 20 bp, homo sapiens
gcccggaatcatgatgcttg

SEQ ID NO: 182 - DNA, 21 bp, homo sapiens
ggccctaggattgtccactca

SEQ ID NO: 183 - DNA, 22 bp, homo sapiens
tcaggacttgcctttgtttcgg

SEQ ID NO: 184 - DNA, 20 bp, homo sapiens
gtgggcctgtgcattgttgg

SEQ ID NO: 185 - DNA, 20 bp, homo sapiens
tagggcaccgggatctctaa

SEQ ID NO: 186 - DNA, 24 bp, homo sapiens
cctgtttgctgctgagaacatctc

SEQ ID NO: 187 - DNA, 23 bp, homo sapiens
aacgctcccctgaaaactgtaac

SEQ ID NO: 188 - DNA, 22 bp, homo sapiens
acagagaccaaagaacccaaga

SEQ ID NO: 189 - DNA, 23 bp, homo sapiens
ggatcgacatgattctgaaggtg

SEQ ID NO: 190 - DNA, 24 bp, homo sapiens
tctccagtgtacccatgatggaag

SEQ ID NO: 191 - DNA, 24 bp, homo sapiens
cccacaagtgtgatcttgaagtcc

SEQ ID NO: 192 - DNA, 23 bp, homo sapiens
cactgtgagtttcatgcctgctg

SEQ ID NO: 193 - DNA, 22 bp, homo sapiens
tcgtggtttcctggacatcttc

SEQ ID NO: 194 - DNA, 22 bp, homo sapiens
gggcttggttttgtgaggttcc

SEQ ID NO: 195 - DNA, 23 bp, homo sapiens
cagggacttcctttttccatcag

SEQ ID NO: 196 - DNA, 27 bp, homo sapiens
ccaagttacgtcaaagtctcaggagca

SEQ ID NO: 197 - DNA, 25 bp, homo sapiens
tctgaaggggtgaagttcttgaggg

SEQ ID NO: 198 - DNA, 24 bp, homo sapiens
aagagaagaccatccaccttaccc

SEQ ID NO: 199 - DNA, 22 bp, homo sapiens
tgctttcacttgtgccactgag

SEQ ID NO: 200 - DNA, 20 bp, homo sapiens
cggccaaggactggaccaga

SEQ ID NO: 201 - DNA, 25 bp, homo sapiens
actccatgagcatgcacagagtagg

SEQ ID NO: 202 - DNA, 20 bp, homo sapiens
actgccaatcctgcgttcca

SEQ ID NO: 203 - DNA, 23 bp, homo sapiens
cgacgtggccattcaatcgtaca

SEQ ID NO: 204 - DNA, 21 bp, homo sapiens
cgcaccacgacgatgacgttc

SEQ ID NO: 205 - DNA, 22 bp, homo sapiens
gatggaccccaggacggagtag

SEQ ID NO: 206 - DNA, 23 bp, homo sapiens
gaccaatagcatctgtgccagag

SEQ ID NO: 207 - DNA, 25 bp, homo sapiens
tgcttctaaccactgaggtatgagg

SEQ ID NO: 208 - DNA, 23 bp, homo sapiens
tcctaaaccattcaccaagagcc

SEQ ID NO: 209 - DNA, 23 bp, homo sapiens
gagcgttgctttccttaaagacc

SEQ ID NO: 210 - DNA, 22 bp, homo sapiens
agcctccctgtctactccattc

SEQ ID NO: 211 - DNA, 20 bp, homo sapiens
ggtaaagtcctcacccctgc

SEQ ID NO: 212 - DNA, 18 bp, homo sapiens
gtggagggaggcctggac

SEQ ID NO: 213 - DNA, 19 bp, homo sapiens
ttaggccacgtgtctgcca

SEQ ID NO: 214 - DNA, 21 bp, homo sapiens
atgccacacaagccagctcac

SEQ ID NO: 215 - DNA, 22 bp, homo sapiens
cagcagcagatgggaagaactc

SEQ ID NO: 216 - DNA, 23 bp, homo sapiens
gctatgtctttgcaccagccacc

SEQ ID NO: 217 - DNA, 23 bp, homo sapiens
gcccacctctacgtcgaagaagt

SEQ ID NO: 218 - DNA, 20 bp, homo sapiens
tccattgtgtcggggatctg

SEQ ID NO: 219 - DNA, 20 bp, homo sapiens
taccccgcagagaagcaaac

SEQ ID NO: 220 - DNA, 20 bp, homo sapiens
agccgagcatacacaccacc

SEQ ID NO: 221 - DNA, 20 bp, homo sapiens
tccagggagatgtcttgcca

SEQ ID NO: 222 - DNA, 21 bp, homo sapiens
atcctacaaccgagccaaccg

SEQ ID NO: 223 - DNA, 20 bp, homo sapiens
cctgctccttctttgcctgg

SEQ ID NO: 224 - DNA, 21 bp, homo sapiens
ccgctgaactcagtcaatggc

SEQ ID NO: 225 - DNA, 20 bp, homo sapiens
tgctgttcatccaaccaccg

SEQ ID NO: 226 - DNA, 20 bp, homo sapiens
tgggcagtttgacttcagca

SEQ ID NO: 227 - DNA, 21 bp, homo sapiens
cactgtaggtcagtcacagca

SEQ ID NO: 228 - DNA, 21 bp, homo sapiens
gtgttcgagggagtgataggg

SEQ ID NO: 229 - DNA, 20 bp, homo sapiens
cagaccctgaggttgcagaa

SEQ ID NO: 230 - DNA, 23 bp, homo sapiens
tgcaccaactgcgtgcaggacga

SEQ ID NO: 231 - DNA, 25 bp, homo sapiens
ggcaccacggggttgtagaagtccc

SEQ ID NO: 232 - DNA, 20 bp, homo sapiens
tgttggccggccttatggtg

SEQ ID NO: 233 - DNA, 21 bp, homo sapiens
ggcggagtaaggcttgtctgt

SEQ ID NO: 234 - DNA, 24 bp, homo sapiens
ggagacttccgacttccttacagg

SEQ ID NO: 235 - DNA, 23 bp, homo sapiens
cctaccactatggcttgtgatgg

SEQ ID NO: 236 - DNA, 24 bp, homo sapiens
ggacttgcgagacttcgtgaggag

SEQ ID NO: 237 - DNA, 22 bp, homo sapiens
ctgaaagagggtctgcgtgtgg

SEQ ID NO: 238 - DNA, 24 bp, homo sapiens
cttctcttcccttcattcttcgcc

SEQ ID NO: 239 - DNA, 24 bp, homo sapiens
cctcctgaccatctcctcttcctc

SEQ ID NO: 240 - DNA, 24 bp, homo sapiens
ggttcttaggctccatcctgtttg

SEQ ID NO: 241 - DNA, 26 bp, homo sapiens
gctgagtagacatgcagatgacaagc

SEQ ID NO: 242 - DNA, 22 bp, homo sapiens
agaccaagcacacctggcaacg

SEQ ID NO: 243 - DNA, 22 bp, homo sapiens
atcttccttgtccgtctcgtcc

SEQ ID NO: 244 - DNA, 25 bp, homo sapiens
ccccgaggacaacctggagatcgtt

SEQ ID NO: 245 - DNA, 25 bp, homo sapiens
cctcgttcgccaccgtatagttgat

SEQ ID NO: 246 - DNA, 24 bp, homo sapiens
caaccacagatcagggacaggagc

SEQ ID NO: 247 - DNA, 20 bp, homo sapiens
ggacagtggcgatttcaacc

SEQ ID NO: 248 - DNA, 21 bp, homo sapiens
gctctttgtgagtgagggtgg

SEQ ID NO: 249 - DNA, 21 bp, homo sapiens
acaggggtgtggacagaaatg

SEQ ID NO: 250 - DNA, 22 bp, homo sapiens
cagtgggcagcagaaaggagag

SEQ ID NO: 251 - DNA, 19 bp, homo sapiens
gggaggagctgaggcaatc

SEQ ID NO: 252 - DNA, 25 bp, homo sapiens
agaaggagatcactgccctggcacc

SEQ ID NO: 253 - DNA, 24 bp, homo sapiens
cctgcttgctgatccacatctgct

SEQ ID NO: 254 - DNA, 613 bp, homo sapiens
gccatggaaaaaccctcgtttatttgattaaacaaaaataaaataagctgcataggaacaattttaaagtccaaagagacaccaactttgttttaaggctgtagtagctgatacagcatctccttgctacctcctccagccttctctgtggaccacagtgatacattcagaagcctgttagctaacacaggagtttttgaacacttttccattggttcttcacctgctcattgcctgtcatgcctgcggcctgcaattagtaacattttaagatttaaaatgtgaaagccaaaagaggaggggggaaaaaaacccaaaatcaaccaaacaaaaactcacttttgcctaaaggtttggggggaaatcttcatttccccacccatctactgcattgatgggattcacattaccacggcagtgcccatttaaaagtggcaaatggcagtcagcaccccaccccggacaggcttgcagtgtggtttctgcggccaggggagttactacggtagtgcatattccttatatcatgtctgccttggacaaatacaaattaagaggtttaacttagtcattctaacataaggcaacttgcccacattaattcccccaattg

SEQ ID NO: 255 - DNA, 23 bp, homo sapiens
atccgccaggtgaaagccaagtc

SEQ ID NO: 256 - DNA, 25 bp, homo sapiens
gggattcacattaccacggcagtgc

SEQ ID NO: 257 - DNA, 2237 bp, homo sapiens
atccgccaggtgaaagccaagtctctgtacctgcaggtggagaagctgcggcaaaacctcaacaagcttgagagcaccatcagtgccgtgcagcaggtcctggaggagggtagagcgctagacatcctactggcccgagaccggatgctggcccaggtgcaggagctgaagaccgtgcggagcctcctgcagccccaggaagacgaccgagtcatgttcacaccccccgatcaggcactgtaccttgccatcaagtcttttggctttgttagcagcggggcctttgccccactcaccaaggccacaggcgatggcctcaagcgtgccctccagggtaaggtggcctccttcacagtcattggttatgaccacgatggtgagccccgcctctcaggaggcgacctgatgtcggctgtggtcctgggccctgatggcaacctgtttggtgcagaggtgagtgatcagcagaatgggacatacgtggtgagttaccgaccccagctggagggtgagcacctggtatctgtgacactgtgcaaccagcacattgagaacagccctttcaaggtggtggtcaagtcaggccgcagctacgtgggcattgggctcccgggcctgagcttcggcagtgagggtgacagcgatggcaagctctgccgcccttggggtgtgagtgtagacaaggagggctacatcattgtcgccgaccgcagcaacaaccgcatccaggtgttcaagccctgcggcgccttccaccacaaattcggcaccctgggctcccggcctgggcagttcgaccgaccagccggcgtggcctgtgacgcctcacgcaggatcgtggtggctgacaaggacaatcatcgcatccagatcttcacgttcgagggccagttcctcctcaagtttggtgagaaaggaaccaagaatgggcagttcaactacccttgggatgtggcggtgaattctgagggcaagatcctggtctcagacacgaggaaccaccggatccagctgtttgggcctgatggtgtcttcctaaacaagtatggcttcgagggggctctctggaagcactttgactccccacggggtgtggccttcaaccatgagggccacttggtggtcactgacttcaacaaccaccggctcctggttattcaccccgactgccagtcggcacgctttctgggctcggagggcacaggcaatgggcagttcctgcgcccacaaggggtagctgtggaccaggaagggcgcatcattgtggcggattccaggaaccatcgggtacagatgtttgaatccaacggcagcttcctgtgcaagtttggtgctcaaggcagcggctttgggcagatggaccgcccttccggcatcgccatcacccccgacggaatgatcgttgtggtggactttggcaacaatcgaatcctcgtcttctaattgcatttcctaggtttctgtgtttggggtgtgtgtgcgtgtctctctctctctctctctctttctctttctctctctttttgaatttcaaagaagaaacagtctcagggaaatttcttttttcttttttttttttaaagagaacaagaaaagtacaacattgcttaagtcctacctcatctttatttttttacagatgaatgtacttatcttttctgcagggattgagcctgtgaagtgataatttctatctacctcataaatctttacatttccttctgcaacaggccctcttcccctcctcagtggagtttgcatttccctcttcccctgcgtggggcatgatatgcacaagcctggcatctgtatggctgggagggcactggatgtgtgtggtggggtgtattctgtagattgagccaaggaaacacaaaaaaaaactactaagtaaaaaaacaaaaaactataaaacatggaaaaaataggatttgaaatgcataattatagaatacctgtgttcttgagaatactgtttatatggggtttagattatgttgtgttgttttgatctttttggaaaatcttctctttttaaatgctgcaacagagaaatttcctctgttctctgtttatacctcttaattgtattgtccaaggcagacatgatataaggaatatgcactaccgtagtaactcccctggccgcagaaaccacactgcaagcctgtccggggtggggtgctgactgccatttgccacttttaaatgggcactgccgtggtaatgtgaatccc

SEQ ID NO: 258 - DNA, 27 bp, homo sapiens
atggcttcgttccccgagaccgatttc

SEQ ID NO: 259 - DNA, 34 bp, homo sapiens
gaagacgaggattcgattgttgccaaagtccacc

SEQ ID NO: 260 - DNA, 2604 bp, homo sapiens
atggcttcgttccccgagaccgatttccagatctgcttgctgtgcaaggagatgtgcggctcgccggcgccgctctcctccaactcgtccgcgtcgtcgtcctcctcgcagacgtccacgtcgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttaacaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgccactcccgcaggcgccgcagccgcccgcgccttcccgctcggcacccggcggccctgccgcttccccgtcggcgctgctgctccgccgtcctcacggctgcagctcgtgcgatgagggcaacgcagcttcttcgcgctgcctcgactgccaggagcacctgtgcgacaactgcgtccgagcgcaccagcgcgtgcgcctcaccaaggaccactacatcgagcgcggcccgccgggtcccggtgccgcagcagcggcgcagcagctcgggctcgggccgccctttcccggcccgcccttctccatcctctcagtgtttcccgagcgcctcggcttctgccagcaccacgacgacgaggtgctgcacctgtactgtgacacttgctctgtacccatctgtcgtgagtgcacaatgggccggcatgggggccacagcttcatctacctccaggaggcactgcaggactcacgggcactcaccatccagctgctggcagatgcccagcagggacgacaggcaatccagctgagcatcgagcaggcccagacggtggcggaacaggtggagatgaaggcgaaggttgtgcagtcggaggtcaaagccgtgactgcgaggcataagaaagccctggaggaacgcgagtgtgagctgctgtggaaggtagaaaagatccgccaggtgaaagccaagtctctgtacctgcaggtggagaagctgcggcaaaacctcaacaagcttgagagcaccatcagtgccgtgcagcaggtcctggaggagggtagagcgctagacatcctactggcccgagaccggatgctggcccaggtgcaggagctgaagaccgtgcggagcctcctgcagccccaggaagacgaccgagtcatgttcacaccccccgatcaggcactgtaccttgccatcaagtcttttggctttgttagcagcggggcctttgccccactcaccaaggccacaggcgatggcctcaagcgtgccctccagggtaaggtggcctccttcacagtcattggttatgaccacgatggtgagccccgcctctcaggaggcgacctgatgtcggctgtggtcctgggccctgatggcaacctgtttggtgcagaggtgagtgatcagcagaatgggacatacgtggtgagttaccgaccccagctggagggtgagcacctggtatctgtgacactgtgcaaccagcacattgagaacagccctttcaaggtggtggtcaagtcaggccgcagctacgtgggcattgggctcccgggcctgagcttcggcagtgagggtgacagcgatggcaagctctgccgcccttggggtgtgagtgtagacaaggagggctacatcattgtcgccgaccgcagcaacaaccgcatccaggtgttcaagccctgcggcgccttccaccacaaattcggcaccctgggctcccggcctgggcagttcgaccgaccagccggcgtggcctgtgacgcctcacgcaggatcgtggtggctgacaaggacaatcatcgcatccagatcttcacgttcgagggccagttcctcctcaagtttggtgagaaaggaaccaagaatgggcagttcaactacccttgggatgtggcggtgaattctgagggcaagatcctggtctcagacacgaggaaccaccggatccagctgtttgggcctgatggtgtcttcctaaacaagtatggcttcgagggggctctctggaagcactttgactccccacggggtgtggccttcaaccatgagggccacttggtggtcactgacttcaacaaccaccggctcctggttattcaccccgactgccagtcggcacgctttctgggctcggagggcacaggcaatgggcagttcctgcgcccacaaggggtagctgtggaccaggaagggcgcatcattgtggcggattccaggaaccatcgggtacagatgtttgaatccaacggcagcttcctgtgcaagtttggtgctcaaggcagcggctttgggcagatggaccgcccttccggcatcgccatcacccccgacggaatgatcgttgtggtggactttggcaacaatcgaatcctcgtcttc

SEQ ID NO: 261 - DNA, 649 bp, homo sapiens
ttttttttttttttttttttttttttttttttttttaaaggccaacgttatatgttttatttttaatcaagtaatttttttaaacctcaacatatccataattgacagaataagacattaggcatgaaatgagaatataaaacccagagtgtacagaaaggcaaacagtgcttcagtccctccagatgactgcatgcgagtgaaacgcattccaaacatctaccccttttttgtcttttaaaaacatacagttcaagtgtttttattttcacttgtaaacaacatgagtcaaaatggacaatgaggtaatctaaatactacacaggataatttaaaaacactagataaaacaccattattaaagacatataaaaatcagggttcactttggtctctagtacggttagttgttaataccaaaaagcaacacatactaattgaagccagcttggtggtaggtgccagtggttgatagatgtgattcaagaggtagtcaacaccatcattttcaagctggtaactctcacaagtgttaagccacagatgcattaaatatcataatacttctcacagtacagtactttaccataacttgcagctttgttccaaatataaaatttaaaaatgaatcataggtcaacttctcact

SEQ ID NO: 262 - DNA, 25 bp, homo sapiens
gggttcactttggtctctagtacgg

SEQ ID NO: 263 - DNA, 3087 bp, homo sapiens
atgcgcggactgacccagcggccggcgcggcggcgccgggcggacttaatcgcgggcgcagcgcgaggctcgggacccagagcaccacctaccggcggcacggtcggcgcagcaggccccagaagggcggggaacgctgtcaagcccaggggcacttcggcgaggagccccacccgccctccagctgaccctcagctgtggcccacatccggggcccagagcgccgcggaaacgccgaagcccggccggcagatagcgcggaaagcgaagaaggaagttcccgtccctcctaaagccgaagccaaagcgaagtctttaaaggccaagaaggcagtgttgaaaggtgtccgcagccacaaaaaaaagaagatccgcacgtcacccaccttacggcggcccaagacaccgcgactccggagacagcccaaatatcctcggaagagcgctcctaggagaaacaagcttgaccactatgctatcatcaagtttctgctgaccactgagtctgccatgaagaagatagaagacaataacacacttgtgttcattgtggatgttaaagccaacaagcaccagattaaacaggctgtgaagaagctctatgacaaagatgtggtcaaggtcaacaccctgattcggcctgatggagagaagaaggcgccgcagccgcccgcgccttcccgctcggcacccggcggccctgccgcttccccgtcggcgctgctgctccgccgtcctcacggctgcagctcgtgcgatgagggcaacgcagcttcttcgcgctgcctcgactgccaggagcacctgtgcgacaactgcgtccgagcgcaccagcgcgtgcgcctcaccaaggaccactacatcgagcgcggcccgccgggtcccggtgccgcagcagcggcgcagcagctcgggctcgggccgccctttcccggcccgcccttctccatcctctcagtgtttcccgagcgcctcggcttctgccagcaccacgacgacgagttggggcttttcactagttctgtgcctccagagtccgaaaggcctgcaggctccgtggcccagccggcatccgggcggggaatccaaggcgaggaatccgaggtcgccgtccccggaacagctggccgcgggcccgctgcgtgccgcgggtcccgggagaggcgggcgcaggctagagcagcaaaggaaacttttctggtacattcttacatccaggccactaatatcagactaggtaacacagtcttaacaacttttctggataatgaagctaagattcagggcaaactctcatgccaggaggtgctgcacctgtactgtgacacttgctctgtacccatctgtcgtgagtgcacaatgggccggcatgggggccacagcttcatctacctccaggaggcactgcaggactcacgggcactcaccatccagctgctggcagatgcccagcagggacgacaggcaatccagacaaagcagaagaagctgcttctgcagctgagcatcgagcaggcccagacggtggcggaacaggtggagatgaaggcgaaggttgtgcagtcggaggtcaaagccgtgacggcgaggcataagaaagccctggaggaacgcgagtgtgagctgctgtggaaggtagaaaagatccgccaggtgaaagccaagtctctgtacctgcaggtggagaagctgcggcaaaacctcaacaagcttgagagcaccatcagtgccgtgcagcaggtcctggaggagggtagagcgctagacatcctactggcccgagaccggatgctggcccaggtgcaggagctgaagaccgtgcggagcctcctgcagccccaggaagacgaccgagtcatgttcacaccccccgatcaggcactgtaccttgccatcaagtcttttggctttgttagcagcggggcctttgccccactcaccaaggccacaggcgatggcctcaagcgtgccctccagggtaaggtggcctccttcacagtcattggttatgaccacgatggtgagccccgcctctcaggaggcgacctgatgtcggctgtggtcctgggccctgatggcaacctgtttggtgcagaggtgagtgatcagcagaatgggacatacgtggtgagttaccgaccccagctggagggtgagcacctggtatctgtgacactgtgcaaccagcacattgagaacagccctttcaaggtggtggtcaagtcaggccgcagctacgtgggcattgggctcccgggcctgagcttcggcagtgagggtgacagcgatggcaagctctgccgcccttggggtgtgagtgtagacaaggagggctacatcattgtcgccgaccgcagcaacaaccgcatccaggtgttcaagccctgcggcgccttccaccacaaattcggcaccctgggctcccggcctgggcagttcgaccgaccagccggcgtggcctgtgacgcctcacgcaggatcgtggtggctgacaaggacaatcatcgcatccagatcttcacgttcgagggccagttcctcctcaagtttggtgagaaaggaaccaagaatgggcagttcaactacccttgggatgtggcggtgaattctgagggcaagatcctggtctcagacacgaggaaccaccggatccagctgtttgggcctgatggtgtcttcctaaacaagtatggcttcgagggggctctctggaagcactttgactccccacggggtgtggccttcaaccatgagggccacttggtggtcactgacttcaacaaccaccggctcctggttattcaccccgactgccagtcggcacgctttctgggctcggagggcacaggcaatgggcagttcctgcgcccacaaggggtagctgtggaccaggaagggcgcatcattgtggcggattccaggaaccatcgggtacagatgtttgaatccaacggcagcttcctgtgcaagtttggtgctcaaggcagcggctttgggcagatggaccgcccttccggcatcgccatcacccccgacggaatgatcgttgtggtggactttggcaacaatcgaatcctcgtcttctaa

SEQ ID NO: 264 - protein, 209 aa, Homo sapiens
MGSVSNQQFAGGCAKAAEEAPEEAPEDAARAADEPQLLHGAGICKWFNVRMGFGFLSMTARAGVALDPPVDVFVHQSKLHMEGFRSLKEGEAVEFTFKKSAKGLESIRVTGPGGVFCIGSERRPKGKSMQKRRSKGDRCYNCGGLDHHAKECKLPPQPKKCHFCQSISHMVASCPLKAQQGPSAQGKPTYFREEEEEIHSPTLLPEAQN

SEQ ID NO: 265 - protein, 227 aa, Caenorhabditis elegans
MSTVVSEGRNDGNNRYSPQDEVEDRLPDVVDNRLTENMRVPSFERLPSPTPRYFGSCKWFNVSKGYGFVIDDITGEDLFVHQSNLNMQGFRSLDEGERVSYYIQERSNGKGREAYAVSGEVEGQGLKGSRIHPLGRKKAVSLRCFRCGKFATHKAKSCPNVKTDAKVCYTCGSEEHVSSICPERRRKHRPEQVAAEEAEAARMAAEKSSPTTSDDDIREKNSNSSDE

SEQ ID NO: 266 - protein, 195 aa, Xenopus laevis
MGSVSNQEITEGLPKSLDGTADIHKSDKSVIFQGSGVCKWFNVRMGFGFLTMTKKEGTDLETPLDVFVHQSKLHMEGFRSLKEGESVEFTFKKSSKGLESTQVTGPGGAPCIGSERRPKVKGQQKRRQRGDRCYNCGGLDHHAKECKLPPQPKKCHFCQNPNHMVAQCPEKAMQAANLEDQPITEEQELIPEIME

SEQ ID NO: 267 - protein, 195 aa, Drosophila melanogaster
MENVQLENGLERRTTSQSSTSSANPANLASPTEECGCVRLGKCKWFNVAKGWGFLTPNDGGQEVFVHQSVIQMSGFRSLGEQEEVEFECQRTSRGLEATRVSSRHGGSCQGSTYRPRINRRTRRMRCYNCGEFANHIASECALGPQPKRCHRCRGEDHLHADCPHKNVTQSHSNSKSISNNSSSSAAQEKSEEAT

SEQ ID NO: 268 - protein, 209 aa, Mus musculus
MGSVSNQQFAGGCAKAAEKAPEEAPPDAARAADEPQLLHGAGICKWFNVRMGFGFLSMTARAGVALDPPVDVFVHQSKLHMEGFRSLKEGEAVEFTFKKSAKGLESIRVTGPGGVFCIGSERRPKGKNMQKRRSKGDRCYNCGGLDHHAKECKLPPQPKKCHFCQSINHMVASCPLKAQQGPSSQGKPAYFREEEEEIHSPALLPEAQN

SEQ ID NO: 269 - DNA, 30 bp, homo sapiens
cgaattcatgggggccccgctcgccgtagc

SEQ ID NO: 270 - DNA, 30 bp, homo sapiens
cctcgaggaggctgcaggcctcctggtcca

SEQ ID NO: 271 - DNA, 21 bp, homo sapiens
ttcgaacgccagcacatggac

SEQ ID NO: 272 - DNA, 21 bp, homo sapiens
gctagttattgctcagcggtg

SEQ ID NO: 273 - DNA, 2233 bp, homo sapiens
  CDS (281)..(1768)
cgattggagcgggccgcagccagcgcacccagaccctgcgctgccctcggacggccgggcgcggagccccagctgcggaggccgacggcacccggccccgagcgcctcgacgccgagccgcgcgcgccttctccgccaggcccggcgggcgggagcgggggcgagggagcaggagcggccagtgcccccgacacccccggcccggcacccccggcccggcatcccccgccgccgccgccgccgcctcaaggccgcccgctccccgcaggtggacgcggccatgggccgaggggtgcgcgtgctgctgctgctgagcctgctgcactgcgccgggggcagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctaggcagactgtctggaggaggagccggcactgaggggcccagacacccgctgccccagtgccacctcaccccccaccagcaggccctcccgtctcttcgggacagggccccagccgtcccccctgtctgggtctgcccactgccctcctgccccggctttccctgcccctctcccacagcccagccagagacaagggacctgctgtcatccccatctgtggcctgggggtccttcctgacaacgagggggtagccagaagagaagcactggattcctcagtccaccagctcagacagcacccaccggccccacccatcaagcccttttatattattttataaagtgacttttttattactttaattttttaaaaaaaggaaaataagaatatatgatgaatgatattgttttgtaactttttaaaaatgattttaaagagacaaaaaagaaaaaaaaaaaaaaa

SEQ ID NO: 274 - protein, 496 aa, homo sapiens
MGRGVRVLLLLSLLHCAGGSEGRKTWRRRGQQPPPPPRTEAAPAAGQPVESFPLDFTAVEGNMDSFMAQVKSLAQSLYPCSAQQLNEDLRLHLLLNTSVTCNDGSPAGYYLKESRGSRRWLLFLEGGWYCFNRENCDSRYDTMRRLMSSRDWPRTRTGTGILSSQPEENPYWWNANMVFIPYCSSDVWSGASSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGIRYWNGVVPERCRRQFQEGEEWNCFFGYKVYPTLRCPVFVVQWLFDEAQLTVDNVHLTGQPVQEGLRLYIQNLGRELRHTLKDVPASFAPACLSHEIIIRSHWTDVQVKGTSLPRALHCWDRSLHDSHKASKTPLKGCPVHLVDSCPWPHCNPSCPTVRDQFTGQEMNVAQFLMHMGFDMQTVAQPQGLEPSELLGMLSNGS

SEQ ID NO: 275 - DNA, 31 bp, homo sapiens
caccgaattcatgggccgaggggtgcgcgtg

SEQ ID NO: 276 - DNA, 30 bp, homo sapiens
ctcgaggcttccgttgctcagcatccccag

SEQ ID NO: 277 - DNA, 32 bp, homo sapiens
gaattcatgcggcgcctcatgagctcccggga

SEQ ID NO: 278 - DNA, 30 bp, homo sapiens
caccatgggatttggattcatctccatgat

SEQ ID NO: 279 - DNA, 31 bp, homo sapiens
tgtctttttccttttttgaactgaaggcccc

SEQ ID NO: 280 - protein, 14 aa, homo sapiens
PEAETRGAKRISPA

SEQ ID NO: 281 - DNA, 34 bp, homo sapiens
ggatccatgggctgtctctggggtctggctctgc

SEQ ID NO: 282 - DNA, 34 bp, homo sapiens
ctcgaggcctctcctgacacgcagtaaggagacc

SEQ ID NO: 283 - protein, 402 aa, homo sapiens
QLSCQGLKVFAGGKLPGPAVEGPSATGPEIIRSPQDDASSPHLQVMLQIHLPGRHTLFVRAMIDSGASGNFIDHEYVAQNGIPLRIKDWPILVEAIDGRPIASGPVVHETHDLIVDLGDHREVLSFDVTQSPFFPVVLGVRWLSTHDPNITWSTRSIVFDSEYCRYHCRMYSPIPPSLPPPAPQPPLYYPVDGYRVYQPVRYYYVQNVYTPVDEHVYPDHRLVDPHIEMIPGAHSIPSGHVYSLSEPEMAALRDFVARNVKDGLITPTIAPNGAQVLQVKRGWKLQVSYDCRAPNNFTIQNQYPRLSIPNLEDQAHLATYTEFVPQIPGYQTYPTYAAYPTYPVGFAWYPVGRDGQGRSLYVPVMITWNPHWYRQPPVPQYPPPQPPPPPPPPPPPPSYSTL

SEQ ID NO: 284 - DNA, 30 bp, homo sapiens
ggatccatgaccgaacgaagaagggacgag

SEQ ID NO: 285 - DNA, 30 bp, homo sapiens
tctagacagggtactgtaagatggaggcgg

SEQ ID NO: 286 - DNA, 28 bp, homo sapiens
ggatccatcttccgggcagacacaccct

SEQ ID NO: 287 - DNA, 29 bp, homo sapiens
ctcgagtgccatttcaggttcggacagtg

SEQ ID NO: 288 - DNA, 26 bp, homo sapiens
gaattcatggagggtctgggccgctc

SEQ ID NO: 289 - DNA, 25 bp, homo sapiens
ctcgagggtgggggccagctcgaag

SEQ ID NO: 290 - protein, 16 aa, homo sapiens
KDDYYRRPLRVLRARQ

SEQ ID NO: 291 - DNA, 30 bp, homo sapiens
cgggatccatgttcctctccatcctagtgg

SEQ ID NO: 292 - DNA, 29 bp, homo sapiens
cgctcgagacactcttttcgggtttgttc

We claim:

1. An isolated protein encoded by the nucleotide sequence represented by SEQ ID NO: 15.

2. An isolated protein or fragment thereof having the amino acid sequence represented by SEQ ID NO:72.

* * * * *